(12) United States Patent
Ehrich et al.

(10) Patent No.: US 9,926,593 B2
(45) Date of Patent: Mar. 27, 2018

(54) PROCESSES AND KITS FOR IDENTIFYING ANEUPLOIDY

(75) Inventors: Mathias Ehrich, San Diego, CA (US);
Guy Del Mistro, San Diego, CA (US);
Cosmin Deciu, San Diego, CA (US);
Yong Qing Chen, San Diego, CA (US);
Ron Michael McCullough, San Diego, CA (US); Roger Chan Tim, La Jolla, CA (US)

(73) Assignee: SEQUENOM, INC., San Diego, CA (US)

( * ) Notice: Subject to any disclaimer, the term of this patent is extended or adjusted under 35 U.S.C. 154(b) by 485 days.

(21) Appl. No.: 13/518,368

(22) PCT Filed: Dec. 20, 2010

(86) PCT No.: PCT/US2010/061319
§ 371 (c)(1),
(2), (4) Date: Feb. 6, 2013

(87) PCT Pub. No.: WO2011/087760
PCT Pub. Date: Jul. 21, 2011

(65) Prior Publication Data
US 2013/0130923 A1    May 23, 2013

Related U.S. Application Data

(60) Provisional application No. 61/289,370, filed on Dec. 22, 2009.

(51) Int. Cl.
*C12Q 1/68* (2006.01)
*G06F 19/20* (2011.01)

(52) U.S. Cl.
CPC .......... *C12Q 1/686* (2013.01); *C12Q 1/6883* (2013.01); *C12Q 1/6886* (2013.01); *G06F 19/20* (2013.01);
(Continued)

(58) Field of Classification Search
None
See application file for complete search history.

(56) References Cited

U.S. PATENT DOCUMENTS 4,109,496 A    8/1978  Allemann et al.
4,179,337 A    12/1979 Davis et al.
(Continued)

FOREIGN PATENT DOCUMENTS

EP    264166    4/1988
EP    0401384   12/1990
(Continued)

OTHER PUBLICATIONS

Jorgez et al. (2011) "Improving Enrichment of Circulating Fetal DNA for Genetic Testing: Size Fractionation Followed by Whole Gene Amplification" Fetal Diagnosis and Therapy 25:314-319.*
(Continued)

*Primary Examiner* — Karen S. Weiler
(74) *Attorney, Agent, or Firm* — Grant IP, Inc.

(57) ABSTRACT

Provided are methods for identifying the presence or absence of a chromosome abnormality by which a cell-free sample nucleic acid from a subject is analyzed. In certain embodiments, provided are methods for identifying the presence or absence of a fetal chromosome abnormality in a nucleic acid from cell-free maternal blood.

16 Claims, 9 Drawing Sheets

Identify sequences that are almost identical between two chromosomes (paralogs)

Mismatch 1 / chr 21  ACCCACACAGTGGGCTTGGTGACATCCTAGGATTTGAT[T]TAT TC CACCC CTAGAATCCAACCT TT CCT
Mismatch 2 / chr 14  TGGGTGTGTCACCCGAACCACTGTAGGATCCTAAACTA[G]ATAAGGTGGGATCTTAGGTTGGAAAGGA Normal:
1000 copies A1 maternal
1000 copies A2 maternal
100 copies A1 fetal
100 copies A2 fetal
Total copies A1: 1100
Total copies A2: 1100
Ratio: 1:1 / 50%

T21:
1000 copies A1 maternal
1000 copies A2 maternal
150 copies A1 fetal
100 copies A2 fetal
Total copies A1: 1150
Total copies A2: 1100
Ratio: 1.045:1 / 51% mass mass

(52) U.S. Cl.
CPC ... *C12Q 2600/156* (2013.01); *C12Q 2600/16* (2013.01)

(56) References Cited

U.S. PATENT DOCUMENTS

| | | |
|---|---|---|
| 4,458,066 A | 7/1984 | Caruthers et al. |
| 4,469,863 A | 9/1984 | Ts'o et al. |
| 4,522,811 A | 6/1985 | Eppstein et al. |
| 4,656,127 A | 4/1987 | Mundy |
| 4,676,980 A | 6/1987 | Segal et al. |
| 4,683,195 A | 7/1987 | Mullis et al. |
| 4,683,202 A | 7/1987 | Mullis |
| 4,851,331 A | 7/1989 | Vary et al. |
| 4,868,103 A | 9/1989 | Stavrianopoulos et al. |
| 4,873,316 A | 10/1989 | Meade et al. |
| 4,965,188 A | 10/1990 | Mullis et al. |
| 5,048,530 A | 9/1991 | Hurwitz |
| 5,075,212 A | 12/1991 | Rotbart |
| 5,118,937 A | 6/1992 | Hillenkamp et al. |
| 5,210,015 A | 5/1993 | Gelfand et al. |
| 5,272,071 A | 12/1993 | Chappel et al. |
| 5,283,317 A | 2/1994 | Saifer et al. |
| 5,487,972 A | 1/1996 | Gelfand et al. |
| 5,492,806 A | 2/1996 | Drmanac et al. |
| 5,525,464 A | 6/1996 | Drmanac et al. |
| 5,536,821 A | 7/1996 | Agrawal et al. |
| 5,541,306 A | 7/1996 | Agrawal et al. |
| 5,547,835 A | 8/1996 | Koster |
| 5,589,330 A | 12/1996 | Shuber |
| 5,605,798 A | 2/1997 | Koster |
| 5,614,622 A | 2/1997 | Iyer et al. |
| 5,631,169 A | 5/1997 | Lakowicz et al. |
| 5,637,683 A | 6/1997 | Usher et al. |
| 5,637,684 A | 6/1997 | Cook |
| 5,656,493 A | 8/1997 | Mullis et al. |
| 5,679,524 A | 10/1997 | Nikiforov et al. |
| 5,691,141 A | 11/1997 | Koster |
| 5,695,940 A | 12/1997 | Drmanac et al. |
| 5,700,922 A | 12/1997 | Cook |
| 5,717,083 A | 2/1998 | Cook et al. |
| 5,719,262 A | 2/1998 | Buchardt et al. |
| 5,720,928 A | 2/1998 | Schwartz |
| 5,739,308 A | 4/1998 | Kandimalla et al. |
| 5,739,314 A | 4/1998 | Roy et al. |
| 5,766,849 A | 6/1998 | McDonough et al. |
| 5,773,601 A | 6/1998 | Agrawal |
| 5,786,146 A | 7/1998 | Herman et al. |
| 5,834,189 A | 11/1998 | Stevens et al. |
| 5,849,483 A | 12/1998 | Shuber |
| 5,849,497 A | 12/1998 | Steinman |
| 5,849,542 A | 12/1998 | Reeve et al. |
| 5,849,546 A | 12/1998 | Sousa et al. |
| 5,851,770 A | 12/1998 | Babon et al. |
| 5,869,242 A | 2/1999 | Kamb |
| 5,876,934 A | 3/1999 | Duthie et al. |
| 5,886,165 A | 3/1999 | Kandimalla et al. |
| 5,891,625 A | 4/1999 | Buchardt et al. |
| 5,908,755 A | 6/1999 | Kumar et al. |
| 5,912,118 A | 6/1999 | Ansorge et al. |
| 5,928,906 A | 7/1999 | Koster et al. |
| 5,929,226 A | 7/1999 | Padmapriya et al. |
| 5,952,174 A | 9/1999 | Nikiforov et al. |
| 5,955,599 A | 9/1999 | Iyer et al. |
| 5,958,692 A | 9/1999 | Cotton et al. |
| 5,962,674 A | 10/1999 | Iyer et al. |
| 5,976,802 A | 11/1999 | Ansorge et al. |
| 5,977,296 A | 11/1999 | Nielsen et al. |
| 5,981,186 A | 11/1999 | Gabe et al. |
| 5,998,143 A | 12/1999 | Ellis et al. |
| 6,004,744 A | 12/1999 | Goelet et al. |
| 6,013,431 A | 1/2000 | Soderlund et al. |
| 6,013,499 A | 1/2000 | Narumiya et al. |
| 6,017,702 A | 1/2000 | Lee et al. |
| 6,018,041 A | 1/2000 | Drmanac et al. |
| 6,024,925 A | 2/2000 | Little et al. |
| 6,043,031 A | 3/2000 | Koster et al. |
| 6,045,996 A | 4/2000 | Cronin et al. |
| 6,046,005 A | 4/2000 | Ju et al. |
| 6,057,134 A | 5/2000 | Leder et al. |
| 6,057,143 A | 5/2000 | Lader et al. |
| 6,087,095 A | 7/2000 | Rosenthal et al. |
| 6,107,037 A | 8/2000 | Sousa et al. |
| 6,110,684 A | 8/2000 | Kemper et al. |
| 6,117,992 A | 9/2000 | Iyer |
| 6,136,541 A | 10/2000 | Gulati |
| 6,140,053 A | 10/2000 | Koster |
| 6,140,054 A | 10/2000 | Wittwer et al. |
| 6,140,482 A | 10/2000 | Iyer et al. |
| 6,142,681 A | 11/2000 | Gulati |
| 6,143,496 A | 11/2000 | Brown et al. |
| 6,156,501 A | 12/2000 | McGall et al. |
| 6,183,958 B1 | 2/2001 | Stanton, Jr. |
| 6,194,144 B1 | 2/2001 | Koster |
| 6,194,180 B1 | 2/2001 | Joyce |
| 6,197,506 B1 | 3/2001 | Fodor et al. |
| 6,210,574 B1 | 4/2001 | Sammons et al. |
| 6,210,891 B1 | 4/2001 | Nyren et al. |
| 6,214,556 B1 | 4/2001 | Olek et al. |
| 6,214,560 B1 | 4/2001 | Yguerabide et al. |
| 6,223,127 B1 | 4/2001 | Berno |
| 6,225,625 B1 | 5/2001 | Pirrung et al. |
| 6,229,911 B1 | 5/2001 | Balaban et al. |
| 6,239,273 B1 | 5/2001 | Pease et al. |
| 6,251,638 B1 | 6/2001 | Umansky et al. |
| 6,258,538 B1 | 7/2001 | Koster et al. |
| 6,258,540 B1 | 7/2001 | Lo et al. |
| 6,297,028 B1 | 10/2001 | Taniguchi et al. |
| 6,326,174 B1 | 12/2001 | Joyce et al. |
| 6,368,834 B1 | 4/2002 | Senapathy et al. |
| 6,440,706 B1 | 8/2002 | Vogelstein et al. |
| 6,468,748 B1 | 10/2002 | Monforte et al. |
| 6,610,492 B1 | 8/2003 | Stanton, Jr. et al. |
| 6,664,056 B2 | 12/2003 | Lo et al. |
| 6,723,513 B2 | 4/2004 | Lexow |
| 6,759,217 B2 | 7/2004 | Kopreski |
| 6,818,394 B1 | 11/2004 | O'Donnell-Maloney et al. |
| 6,884,586 B2 | 4/2005 | Van Ness et al. |
| 6,916,634 B2 | 7/2005 | Kopreski |
| 6,927,028 B2 | 8/2005 | Dennis et al. |
| 6,929,911 B2 | 8/2005 | Oefner et al. |
| 7,081,339 B2 | 7/2006 | Slepnev |
| 7,169,314 B2 | 1/2007 | Unger et al. |
| 7,244,567 B2 | 7/2007 | Chen et al. |
| 7,253,259 B2 | 8/2007 | Otagiri et al. |
| 7,285,422 B1 | 10/2007 | Little et al. |
| 7,468,249 B2 | 12/2008 | Xie et al. |
| 7,655,399 B2 | 2/2010 | Cantor et al. |
| 7,709,262 B2 | 5/2010 | Cantor et al. |
| 7,785,798 B2 | 8/2010 | Cantor et al. |
| 8,195,415 B2 | 6/2012 | Fan et al. |
| 2001/0008615 A1 | 7/2001 | Little et al. |
| 2001/0051341 A1 | 12/2001 | Lo et al. |
| 2002/0006621 A1 | 1/2002 | Bianchi |
| 2003/0022207 A1 | 1/2003 | Balasubramanian et al. |
| 2003/0082600 A1 | 5/2003 | Olek et al. |
| 2003/0087276 A1 | 5/2003 | Kopreski |
| 2003/0096426 A1 | 5/2003 | Little et al. |
| 2003/0180748 A1 | 9/2003 | Braun et al. |
| 2003/0180779 A1 | 9/2003 | Lofton-Day et al. |
| 2003/0211483 A1 | 11/2003 | Schroeder et al. |
| 2003/0211522 A1 | 11/2003 | Landes et al. |
| 2004/0014105 A1 | 1/2004 | Schroeder et al. |
| 2004/0081993 A1 | 4/2004 | Cantor et al. |
| 2004/0115684 A1 | 6/2004 | Costa |
| 2004/0137470 A1 | 7/2004 | Dhallan |
| 2004/0203037 A1 | 10/2004 | Lo et al. |
| 2005/0037388 A1 | 2/2005 | Antonarakis et al. |
| 2005/0059003 A1 | 3/2005 | Enoki et al. |
| 2005/0064406 A1 | 3/2005 | Zabarobsky et al. |
| 2005/0064428 A1 | 3/2005 | Berlin |
| 2005/0069879 A1 | 3/2005 | Berlin |
| 2005/0079521 A1 | 4/2005 | Beaulieu et al. |
| 2005/0112590 A1 | 5/2005 | Boom et al. |
| 2005/0009059 A1 | 7/2005 | Shapero et al. |

(56) References Cited

U.S. PATENT DOCUMENTS

| | | |
|---|---|---|
| 2005/0019762 A1 | 7/2005 | Olek |
| 2005/0153316 A1 | 7/2005 | Jeddeloh et al. |
| 2005/0153347 A1 | 7/2005 | Shapero et al. |
| 2005/0164241 A1 | 7/2005 | Hahn et al. |
| 2005/0266473 A1 | 12/2005 | Zhang et al. |
| 2005/0272070 A1 | 12/2005 | Ehrich et al. |
| 2005/0287592 A1 | 12/2005 | Kless |
| 2006/0019278 A1 | 1/2006 | Lo et al. |
| 2006/0094039 A1 | 5/2006 | Rosenfeld et al. |
| 2006/0136142 A1 | 7/2006 | Berlin et al. |
| 2006/0160105 A1 | 7/2006 | Dhallan |
| 2006/0166228 A1 | 7/2006 | Page et al. |
| 2006/0210992 A1 | 9/2006 | van den Boom |
| 2006/0252068 A1 | 11/2006 | Lo et al. |
| 2006/0252071 A1 | 11/2006 | Lo et al. |
| 2007/0048755 A1 | 3/2007 | Di Fiore |
| 2007/0059707 A1 | 3/2007 | Cantor et al. |
| 2007/0065823 A1 | 3/2007 | Dressman et al. |
| 2007/0111233 A1 | 5/2007 | Bianchi et al. |
| 2007/0202525 A1 | 8/2007 | Quake et al. |
| 2007/0207466 A1 | 9/2007 | Cantor et al. |
| 2007/0212689 A1 | 9/2007 | Bianchi et al. |
| 2007/0243549 A1 | 10/2007 | Bischoff |
| 2007/0275402 A1 | 11/2007 | Lo et al. |
| 2008/0020390 A1 | 1/2008 | Mitchell et al. |
| 2008/0070792 A1 | 3/2008 | Stoughton et al. |
| 2008/0096766 A1 | 4/2008 | Lee |
| 2008/0299562 A1 | 12/2008 | Oeth |
| 2008/0305479 A1 | 12/2008 | Van Den Boom |
| 2009/0026082 A1 | 1/2009 | Rothberg et al. |
| 2009/0029377 A1 | 1/2009 | Lo et al. |
| 2009/0053719 A1 | 2/2009 | Lo et al. |
| 2009/0061425 A1 | 3/2009 | Lo et al. |
| 2009/0087847 A1* | 4/2009 | Lo et al. .......................... 435/6 |
| 2009/0111712 A1 | 4/2009 | Van Den Boom |
| 2009/0142755 A1 | 6/2009 | Albitar |
| 2009/0202984 A1 | 8/2009 | Cantor |
| 2009/0317817 A1 | 12/2009 | Oeth et al. |
| 2009/0317818 A1 | 12/2009 | Ehrich et al. |
| 2010/0105049 A1 | 4/2010 | Ehrich et al. |
| 2010/0184046 A1 | 7/2010 | Klass et al. |
| 2010/0203529 A1 | 8/2010 | Kuslich et al. |
| 2010/0216153 A1 | 8/2010 | Lapidus et al. |
| 2010/0227320 A1 | 9/2010 | Fu |
| 2010/0240054 A1 | 9/2010 | Bischoff |
| 2010/0273165 A1 | 10/2010 | Ehrich et al. |
| 2010/0279295 A1 | 11/2010 | Roy et al. |
| 2011/0033851 A1 | 2/2011 | Rand |
| 2011/0105353 A1 | 5/2011 | Lo et al. |
| 2011/0151460 A1 | 6/2011 | Klass et al. |
| 2011/0177517 A1 | 7/2011 | Rava et al. |
| 2011/0178түр A1 | 7/2011 | Rabinowirz et al. |
| 2011/0183338 A1* | 7/2011 | Bischoff .............. C12Q 1/6806 435/6.12 |
| 2011/0201507 A1 | 8/2011 | Rava et al. |
| 2011/0212846 A1 | 9/2011 | Spier |
| 2011/0224087 A1 | 9/2011 | Quake et al. |
| 2011/0276277 A1 | 11/2011 | Lo et al. |
| 2011/0288780 A1 | 11/2011 | Rabinowirz et al. |
| 2012/0184449 A1 | 7/2012 | Hixson et al. |
| 2012/0264618 A1 | 10/2012 | Nygren |
| 2012/0276542 A1 | 11/2012 | Nygren |
| 2012/0277119 A1 | 11/2012 | Ehrich et al. |
| 2012/0282613 A1 | 11/2012 | Patsalis et al. |
| 2013/0143211 A1 | 6/2013 | Ehrich et al. |
| 2013/0150249 A1 | 6/2013 | Ehrich et al. |
| 2013/0230858 A1 | 9/2013 | Cantor et al. |
| 2013/0295564 A1 | 11/2013 | Ehrich et al. |
| 2013/0296180 A1 | 11/2013 | Ehrich et al. |
| 2013/0310260 A1 | 11/2013 | Kim et al. |
| 2014/0093873 A1 | 4/2014 | Tynan et al. |

FOREIGN PATENT DOCUMENTS

| | | |
|---|---|---|
| EP | 1 373 561 | 2/2009 |
| EP | 1524321 | 4/2009 |
| JP | 2005-514956 | 5/2005 |
| JP | 2008-521389 | 6/2008 |
| WO | WO 91/006667 | 5/1991 |
| WO | WO 94/010300 | 5/1994 |
| WO | WO 97/012058 | 4/1997 |
| WO | WO 97/035589 | 10/1997 |
| WO | WO 97/037041 | 10/1997 |
| WO | WO 98/020020 | 5/1998 |
| WO | WO 98/022489 | 5/1998 |
| WO | WO 98/039352 | 9/1998 |
| WO | WO 98/039474 | 9/1998 |
| WO | WO 98/054364 | 12/1998 |
| WO | WO 99/057318 | 5/1999 |
| WO | WO 00/056746 | 9/2000 |
| WO | WO 00/066771 | 11/2000 |
| WO | WO 00/075372 | 12/2000 |
| WO | WO 01/014398 | 3/2001 |
| WO | WO 01/027326 | 4/2001 |
| WO | WO 01/027327 | 4/2001 |
| WO | WO 01/027329 | 4/2001 |
| WO | WO 02/018616 | 3/2002 |
| WO | WO 02/086163 | 10/2002 |
| WO | WO 03/057909 | 7/2003 |
| WO | WO 03/062441 | 7/2003 |
| WO | WO 03/080863 | 10/2003 |
| WO | WO 04/013284 | 2/2004 |
| WO | WO 00/052625 | 9/2004 |
| WO | WO 04/076653 | 9/2004 |
| WO | WO 04/079011 | 9/2004 |
| WO | WO 05/012578 | 2/2005 |
| WO | WO 01/020039 | 3/2005 |
| WO | WO 05/021793 | 3/2005 |
| WO | WO 05/023091 | 3/2005 |
| WO | WO 01/025485 | 4/2005 |
| WO | WO 01/027419 | 4/2005 |
| WO | WO 05/035725 | 4/2005 |
| WO | WO 05/040399 | 5/2005 |
| WO | WO 05/098050 | 10/2005 |
| WO | WO 06/056480 | 6/2006 |
| WO | WO 06/097049 | 9/2006 |
| WO | WO 06/097051 | 9/2006 |
| WO | WO 03/000919 | 1/2007 |
| WO | WO 07/016668 | 2/2007 |
| WO | WO 07/028155 | 3/2007 |
| WO | WO 07/092473 | 8/2007 |
| WO | WO 2007/100911 | 9/2007 |
| WO | WO 07/121276 | 10/2007 |
| WO | WO 07/132166 | 11/2007 |
| WO | WO 07/132167 | 11/2007 |
| WO | WO 07/140417 | 12/2007 |
| WO | WO 07/147063 | 12/2007 |
| WO | WO 08/098142 | 8/2008 |
| WO | WO 08/103761 | 8/2008 |
| WO | WO 08/103763 | 8/2008 |
| WO | WO 08/118988 | 10/2008 |
| WO | WO 2009/013492 | 1/2009 |
| WO | WO 2009/019455 | 2/2009 |
| WO | WO 2009/039507 | 3/2009 |
| WO | WO 09/046445 | 4/2009 |
| WO | WO 09/114543 | 9/2009 |
| WO | WO 10/004265 | 1/2010 |
| WO | WO 10/033639 | 3/2010 |
| WO | WO 10/065470 | 6/2010 |
| WO | WO 10/115016 | 10/2010 |
| WO | WO 11/034631 | 3/2011 |
| WO | WO 11/087760 | 7/2011 |
| WO | WO 11/091063 | 7/2011 |
| WO | WO 11/092592 | 8/2011 |
| WO | WO 11/142836 | 11/2011 |
| WO | WO 11/143659 | 11/2011 |
| WO | WO 12/149339 | 11/2011 |
| WO | WO 12/118745 | 9/2012 |
| WO | WO 08/157264 | 12/2012 |
| WO | WO 09/032779 | 3/2013 |
| WO | WO 09/032781 | 3/2013 |

(56) References Cited

FOREIGN PATENT DOCUMENTS

| WO | WO 13/052913 | 4/2013 |
|----|--------------|--------|
| WO | WO 13/055817 | 4/2013 |
| WO | WO 09/091934 | 7/2013 |

OTHER PUBLICATIONS

International Search Report and Written Opinion dated Jul. 1, 2013 in International Application No. PCT/US2013/028699, filed on Mar. 1, 2013.
Go et al., "Non-invasive aneuploidy detection using free fetal DNA and RNA in maternal plasma: recent progress and future possibilities" Human Reproduction Update (2011) 17(3):372-382.
Beaudet, "Progress toward noninvasive prenatal diagnosis" Clin. Chem. (2011) 57(6):802-804.
Office Action dated Aug. 13, 2013 in U.S. Appl. No. 13/517,508, filed Jun. 13, 2012 and published as US 2013-0143211 on Jun. 6, 2013.
Chan et al., "Hypermethylated RASSFIA in Maternal Plasma: A Universal Fetal DNA Marker that Improves the Reliability of Noninvasive Prenatal Diagnosis" Clin. Chem. (2006) 52:2211-2218.
International Search Report and Written Opinion dated Jul. 16, 2013 in International Application No. PCT/US2013/041906, filed on May 20, 2013.
Tabor et al., "Non-Invasive Fetal Genome Sequencing: Opportunities and Challenges" American Journal of Medical genetics Part A (2012) 158A(10):2382-2384.
Kitzman et al., "Noninvasive Whole-Genome Sequencing of a Human Fetus" Science Translation Medicine (2012) 4(137-140):115-122.
Office Action dated Nov. 7, 2014 in U.S. Appl. No. 13/791,466, filed Mar. 8, 2013 and published as US 2013-0295564 on Nov. 7, 2013.
International Preliminary Report on Patentability dated Dec. 4, 2014 in International Application No. PCT/US2013/041906, filed on May 20, 2013 and published as WO 2013/177086 on Nov. 28, 2013.
Office Action dated Dec. 18, 2014 in U.S. Appl. No. 13/517,508, filed Jun. 13, 2012 and published as US 2013-0143211 on Jun. 6, 2013.
Office Action dated Dec. 22, 2014 in U.S. Appl. No. 13/801,384, filed Mar. 13, 2013 and published as US 2013-0296180 on Nov. 7, 2013.
Bock et al., "CpG island methylation in human lymphocytes is highly correlated with DNA sequence, repeats, and predicted DNA structure" PLOS Genetics (2006) 2(3):e26.
Cross et al., "Purification of CpG islands using a methylated DNA binding column" Nature Genetics (1994) 6(3):236-244.
Hua et al., "Quantitative methylation analysis of multiple genes using methylation-sensitive restriction enzyme-based quantitative PCR for the detection of hepatocellular carcinoma" Experimental and Molecular Pathology (2011) 91:455-460.
Roach et al., "Association between the abnormal expression of matrix-degrading enzymes by human osteoarthritic chondrocytes and demethylation of specific CpG sites in the promoter regions" Arthritis & Rheumatism (2005) 52(10):3110-3124.
Yamada et al., "Suppressive effect of epigallocatechin gallate (EGCg) on DNA methylation in mice: Detection by methylation sensitive restriction endonuclease digestion and PCR" Journal of Food, Agriculture & Environment (2005) 3(2):73-76.
International Search Report and Written Opinion dated Jul. 30, 2014 in International Application No. PCT/US2014/025132, filed on Mar. 13, 2014.
Office Action dated Aug. 8, 2014 in U.S. Appl. No. 13/782,901, filed Mar. 1, 2013 and published as US 2013-0230858 on Sep. 5, 2013.
International Preliminary Report on Patentability dated Sep. 12, 2014 in International Application No. PCT/US2013/028699, filed on Mar. 1, 2013 and published as WO 2013/131021 on Sep. 6, 2013.
Office Action dated Sep. 15, 2014 in U.S. Appl. No. 12/727,198, filed Mar. 18, 2010 and published as US 2010-0273165 on Oct. 28, 2010.
International Search Report and Written Opinion dated Aug. 14, 2013 in International Application No. PCT/US2013/041354, filed on May 16, 2013.
Office Action dated Sep. 20, 2013 in U.S. Appl. No. 13/517,532, filed Jun. 13, 2012 and published as US 2013-0150249 on Jun. 13, 2013.
Office Action dated Sep. 24, 2013 in U.S. Appl. No. 13/495,975, filed Jun. 13, 2012 and published as US 2012-0277119 on Nov. 1, 2012.
Sayres et al., "Cell-free fetal nucleic acid testing: A review of the technology and its applications" Obstetrical and Gynecological Survey (2011) 66(7):431-442.
Sharma et al., "Mass spectrometric based analysis, characterization and applications of circulating cell free DNA isolated from human body fluids" International Journal of Mass Spectrometry (2011) 304:172-183.
NCBI dbSNP cluster report record for rs16139, accessed Sep. 16, 2013.
International Search Report and Written Opinion dated Oct. 23, 2013 in International Application No. PCT/US2013/050145, filed on Jul. 11, 2013.
Tsui et al., "Systemic Identification of Placental Epigenetic Signatures for the Noninvasive Prenatal Detection of Edwards Syndrome" PLOS One (2010) 5(11):e15069.
Lo and Chiu, "Prenatal diagnosis: progress through plasma nucleic acids" Nature Reviews Genetics (2007) 8:71-77.
International Preliminary Report on Patentability dated Nov. 7, 2013 in International Application No. PCT/US2012/035479, filed on Apr. 27, 2012 and published as WO 2012/149339 on Nov. 1, 2012.
Office Action dated Nov. 22, 2013 in U.S. Appl. No. 12/401,493, filed Mar. 10, 2009 and published as US 2009-0317817 on Dec. 24, 2009.
Office Action dated Dec. 31, 2013 in U.S. Appl. No. 12/727,198, filed Mar. 18, 2010 and published as US 2010-0273165 on Oct. 28, 2010.
Office Action dated Jan. 7, 2014 in U.S. Appl. No. 13/517,508, filed Jun. 13, 2012 and published as US 2013-0143211 on Jun. 6, 2013.
Adinolfi et al., "Rapid detection of aneuploidies by microsatellite and the quantitative fluorescent polymerase chain reaction." Prenat Diagn. Dec. 1997;17(13):1299-311.
Agresti, Categorical Data Analysis, 2nd Ed. 2002. Wiley.
Altschul et al., "Basic local alignment search tool." J Mol Biol. Oct. 5, 1990;215(3):403-10.
Altschul et al., "Gapped BLAST and PSI-BLAST: a new generation of protein database search programs." Nucleic Acids Res. Sep. 1, 1997;25(17):3389-402.
Amicucci et al., Clin. Chem. 46:301-302, 2000.
Amir et al., Nature Genet. 23:185-88 (1999).
Anantha et al., "Porphyrin binding to quadrupled T4G4." Biochemistry. Mar. 3, 1998;37(9):2709-14.
Anders et al., Clin Chem, Oct. 2010, 56(10):1627-1635, Epub Aug. 20, 2010.
Anderson, S., "Shotgun DNA sequencing using cloned Dnase I-generated fragments," Nucl. Acids Res. 9:3015-3027 (1981.
Antonarakis et al., Am J Hum Genet. Mar. 1992;50(3):544-50.
Antonarakis et al., Nat Genet. Feb. 1993;3(2):146-50.
Aoki E. et al., "Methylation status of the pl51NK4B gene in hematopoietic progenitors and peripheral blood cells in myelodysplastic syndromes", Leukemia 14(4):586-593 (2000.
Armour et al., "Measurement of locus copy number by hybridisation with amplifiable probes." Nucleic Acids Res. Jan. 15, 2000;28(2):605-9.
Armour et al., "The detection of large deletions or duplications in genomic DNA." Hum Mutat. Nov. 2002;20(5):325-37.
Asimakopoulos FA et al., "ABL 1 methylation is a distinct molecular event associated with clonal evolution of chronic myeloid leukemia" Blood 94(7):2452-2460 (1999.
Aston et al. (1999) Methods Enzymol. 303:55-73.
Aston et al. (1999) Trends Biotechnol. 17(7):297-302.

(56) References Cited

OTHER PUBLICATIONS

Ausubel et al., Current Protocols in Molecular Biology (Ausubel et al., eds., 1994).
Banerji et al., "A lymphocyte-specific cellular enhancer is located downstream of the joining region in immunoglobulin heavy chain genes." Cell. Jul. 1983;33(3):729-40.
Bartel et al., Biotechniques 14: 920-924 (1993.
Batey et al. (1992) Nucl. Acids Res. 20, 4515-4523.
Batey et al. (1996) Nucl. Acids Res. 24, 4836-4837.
Batzer et al., Nucleic Acid Res. 19:5081 (1991).
Beaucage & Caruthers, Tetrahedron Lett. 22: 1859-1862 (1981).
Beckman Coulter, Introduction to Capillary Electrophoresis, Beckman Coulter 1991.
Benson G. Tandem repeats finder: a program to analyze DNA sequences. Nucleic Acids Res. Jan. 15, 1999;27(2):573-80).
Bianchi, 'Fetal cells in the mother: from genetic diagnosis to diseases associated with fetal cell microchimerism', In: European Journal of Obstetrics & Gynecology and Reproductive Biology, Sep. 2000, vol. 92(I), pp. 103-108.
Boguski et al., "Identification of a cytidine-specific ribonuclease from chicken liver." J Biol Chem. Mar. 10, 1980;255(5):2160-3.
Boom et al. (1990, J. Clin. Microbiol. 28: 495-503.
Boom et al. (1991, J. Clin. Microbiol. 29: 1804-1811.
Boyer, L.A. et al. Polycomb complexes repress developmental regulators in murine embryonic stem cells. Nature 441, 349-53 (2006).
Braslavsky et al., "Sequence information can be obtained from single DNA molecules." Proc Natl Acad Sci U S A. Apr. 1, 2003;100(7):3960-4. Epub Mar. 21, 2003.
Brizot et al., "Maternal serum hCG and fetal nuchal translucency thickness for the prediction of fetal trisomies in the first trimester of pregnancy." Br J Obstet Gynaecol. Feb. 1995;102(2):127-32.
Bullinger et al., "Use of gene-expression profiling to identify prognostic subclasses in adult acute myeloid leukemia." N Engl J Med. Apr. 15, 2004;350(16):1605-16.
Burlingame et al. Anal. Chem. 70:647R-716R (1998).
Burnier et al., "Cell-derived microparticles in haemostasis and vascular medicine," Thromb Haemost 2009, 101:439-451.
Byrne et al., "Multiplex gene regulation: a two-tiered approach to transgene regulation in transgenic mice." Proc Natl Acad Sci U S A. Jul. 1989;86(14):5473-7.
Calame et al., "Transcriptional controlling elements in the immunoglobulin and T cell receptor loci." Adv Immunol. 1988;43:235-75.
Caliper LifeSciences, Products and Contract Services, LabChip GX 2010, printed from the internet on Mar. 15, 2011 (http://www.caliperl.com/products/labchip-gx.htm).
Camper et al., "Postnatal repression of the alpha-fetoprotein gene is enhancer independent." Genes Dev. Apr. 1989;3(4):537-46.
Cell Death Detection ELISA PLUS Cat. No. 11 774 425 001 "Detection of Post-translational Modifications on Native Intact Nucleosomes by ELISA," Version 11.0, Roche, Content Version: Sep. 2010, pp. 1-19.
Chan et al. (2004) Clin. Chem. 50:88-92.
Chan et al., Oncogene 22:924-934 (2003.
Chang et al., "LIBSVM: a library for Support Vector Machines," 2001.
Chen et al., "Fluorescence energy transfer detection as a homogeneous DNA diagnostic method." Proc Natl Acad Sci U S A. Sep. 30, 1997;94(20):10756-61.
Chen et al., "Template-directed dye-terminator incorporation (TDI) assay: a homogeneous DNA diagnostic method based on fluorescence resonance energy transfer." Nucleic Acids Res. Jan. 15, 1997;25(2):347-53.
Cheson et al, "Report of the National Cancer Institute-sponsored workshop on definitions of diagnosis and response in acute myeloid leukemia" J Clin Oncol 8:813-819, 1990.
Cheung et al. (1994, J. Clin. Microbiol. 32: 2593-2597).
Chirgwin et al. (1979, Biochem. 18: 5294-5299.
Chitty, L. Br Med Bull 54:839-856 (1998).
Chiu et al., "Effects of blood-processing protocols on fetal and total DNA quantification in maternal plasma." Clin Chem. Sep. 2001;47(9):1607-1613.
Chiu et al., Lancet 360:998-1000, 2002.
Chomczynski and Mackey (1995, Anal. Biochem. 225: 163-164).
Chomczynski and Mackey (1995, Biotechniques 19: 942-945).
Chomczynski and Sacchi (1987, Analytical Biochem. 162: 156-159).
Chomczynski, (1993, Biotech. 15: 532-537).
Chow, K.C., et al., Mass Spectrometric detection of a SNP panel as an internal positive control for fetal DNA analysis in maternal plasma. Clin. Chem. 53, 141-142 (2007).
Chu et al, "A novel approach toward the challenge of accurately quantifying fetal DNA in maternal plasma," Prenatal Diagnosis, 2010; 30:1226-1229.
Colella et al. Biotechniques. Jul. 2003;35(1):146-50.
Costa et al., N. Engl. J. Med. 346:1502, 2002).
Costello et al., Restriction Landmark Genomic Scanning (RLGS): Analysis of CpG Islands in genomes by 2D Gel Electrophoresis, Methods in Molecular Biology, DNA Methylation, 2 Methods and Protocols, v.: 507, 2nd eds., pp. 131-148 (2000).
Cruikshank et al., "A lipidated anti-Tat antibody enters living cells and blocks HIV-1 viral replication." J. Acquired Immune Deficiency Syndromes and Human Retrovirology Mar. 1, 1997;14(3):193-203.
Current Protocols in Molecular Biology, John Wiley & Sons, N.Y. , 6.3.1-6.3.6 (1989).
Dai et al., "Detection of Post-translational Modifications on Native Intact Nucleosomes by ELISA," Journal of Visualized Experiments, 2011, pp. 1-4.
D'Alton., "Prenatal diagnostic procedures." Semin Perinatol. Jun. 1994;18(3):140-62.
Das, R. et al. Proc Natl Acad Sci U S A 103, 10713-6 (2006).
Davison., "Sedimentation of deoxyribonucleic acid isolated under low hydrodynamic shear." Nature. Mar. 26, 1960;185:918-20.
Davison., "The Effect of Hydrodynamic Shear on the Deoxyribonucleic Acid From T(2) and T(4) Bacteriophages." Proc Natl Acad Sci U S A. Nov. 1959;45(11):1560-8.
Dayie et al. (1998) J. Mag. Reson. 130, 97-101 (1998).
Dear, "One by one: Single molecule tools for genomics." Brief Funct Genomic Proteomic. Jan. 2003;1(4):397-416.
Deininger, P. L. "Random subcloning of sonicated DNA: application to shotgun DNA sequence analysis," Anal. Biochem. 129(1):216-223 (1983).
Dembo et al., 1994, Ann. Prob. 22: 2022-2039.
Ding C, Cantor CR (2003) A high-throughput gene expression analysis technique using competitive PCR and matrix-assisted laser desorption ionization time-of-flight MS. Proc Natl Acad Sci U S A 100:3059-3064.
Donis-Keller et al., Nucl. Acids Res. 4:2527-2537 (1977).
Donis-Keller., "Phy M: an RNase activity specific for U and A residues useful in RNA sequence analysis." Nucleic Acids Res. Jul. 25, 1980;8(14):3133-42.
Dupont JM, Tost J, Jammes H, and Gut IG. Anal Biochem, Oct. 2004; 333(1): 119-27.
Eads et al., Cancer Res. 59:2302-2306, 1999.
Eckhardt, F. et al. Nat Genet 38, 1378-85 (2006.
Edlund et al., "Cell-specific expression of the rat insulin gene: evidence for role of two distinct 5' flanking elements." Science. Nov. 22, 1985;230(4728):912-6.
Egger et al., "Reverse transcription multiplex PCR for differentiation between polio- and enteroviruses from clinical and environmental samples." J Clin Microbiol. Jun. 1995;33(6):1442-7.
Ehrich et al., "Noninvasive detection of fetal trisomy 21 by sequencing of DNA in maternal blood: a study in a clinical setting," Reports of Major Impact, American Journal of Obstetrics and Gyenocology, Mar. 2011, 205e1-205e11.
Ehrich et al., A new method for accurate assessment of DNA quality after bisulfite treatment, Nucl. Acids Res. (2007) 35(5): e29 1-8.
Ehrich M, et al. (2005) Quantitative high-throughput analysis of DNA methylation patterns by base specific cleavage and mass spectrometry. Proc Natl Acad Sci U S A 102:15785-15790.
Ehrich M, et al. (2008) Cytosine methylation profiling of cancer cell lines. Proc Natl Acad Sci U S A 105:4844-48.

(56) References Cited

OTHER PUBLICATIONS

Eiben et al., "First-trimester screening: an overview." J Histochem Cytochem. Mar. 2005;53(3):281-3.
Ernani et al., Agilent's SureSelect Target Enrichment System: Bringing Cost and Process Efficiency to Next-Generation Sequencing Product Note, Agilent Technologies, Mar. 16, 2009.
Eva and Aaronson, Nature, 316:273-275, 1985.
Extended European Search Report dated: Apr. 19, 2012 in European Application No. EP 09815148 filed: Sep. 16, 2009.
Fajkusova L. et al., "Detailed Mapping of Methylcytosine Positions at the CpG Island Surrounding the Pa Promoter at the bcr-abl Locus in CML Patients and in Two Cell Lines, K562 and BV173" Blood Cells Mol. Dis. 26(3):193-204 (2000).
Fan et al., "Noninvasive diagnosis of fetal aneuploidy by shotgun sequencing DNA from maternal blood." Proc Natl Acad Sci U S A. Oct. 21, 2008;105(42):16266-71. Epub Oct. 6, 2008.
Fan et al., "Working Set Selection Using the Second Order Information for Training SVM" Journal of Machine Learning Research 6 (2005) 1889-1918.
Feinberg., "Methylation meets genomics." Nat Genet. Jan. 2001;27(1):9-10.
Ferguson-Smith, "Placental mRNA in maternal plasma: Prospects for fetal screening", PNAS vol. 100, No. 8, 4360-4362 Apr. 15, 2003.
Fournie et al. (1986 Anal. Biochem. 158: 250-256).
Frommer et al. (Proc. Natl. Acad. Sci. USA 89:1827-1831, 1992.
Futreal, P.A. et al. Nat Rev Cancer 4, 177-83 (2004).
Gardiner-Garden et al., "CpG islands in vertebrate genomes." J Mol Biol. Jul. 20, 1987;196(2):261-82.
Gebhard C, Schwarzfischer L, Pham TH, Andreesen R, Mackensen A, Rehli M (2006) Rapid and sensitive detection of CpG-methylation using methyl-binding (MB)-PCR. Nucleic Acids Res 34:e82.
Gebhard C, Schwarzfischer L, Pham TH, Schilling E, Klug M, Andreesen R, Rehli M (2006) Genomewide profiling of CpG methylation identifies novel targets of aberrant hypermethylation in myeloid leukemia. Cancer Res 66:6118-6128).
Giles et al., "Acute myeloid leukemia." Hematology Am Soc Hematol Educ Program. 2002:73-110.
Go et al. Clin Chem. Dec. 2007;53(12):2223-4.
Goeddel, Gene Expression Technology: Methods in Enzymology 185, Academic Press, San Diego, CA (1990).
Gonzalgo & Jones, Nucleic Acids Res. 25:2529-2531, 1997.
Gottesman, S., Gene Expression Technology: Methods in Enzymology, Academic Press, San Diego, California 185: 119-129 (1990).
Grompe et al., Proc. Natl. Acad. Sci. USA 86: 5855-5892 (1989.
Grompe., "The rapid detection of unknown mutations in nucleic acids." Nat Genet. Oct. 1993;5(2):111-7.
Grunau et al., "Bisulfite genomic sequencing: systematic investigation of critical experimental parameters." Nucleic Acids Res. Jul. 1, 2001;29(13):E65-5.
Gupta et al., "Use of specific endonuclease cleavage in RNA sequencing." Nucleic Acids Res. Jun. 1977;4(6):1957-78.
Haase et al., Methods in Virology, pp. 189-226, 1984.
Haddow, et al.,"Screening of maternal serum for fetal Down's syndrome in the first trimester", In: The New England Journal of Medicine, Apr. 2, 1998, Vol.338(14), pp. 955-961.
Hage & Tweed, J. Chromatogr. B Biomed. Sci. Appl. Oct. 10; 699 (1-2): 499-525 (1997).
Hahn et al., (2011) Placenta 32 Suppl: S17-S20.
Hahner et al., "Matrix-assisted laser desorption/ionization mass spectrometry (MALDI) of endonuclease digests of RNA." Nucleic Acids Res. May 15, 1997;25(10):1957-64.
Hames and Higgins eds., Nucleic Acid Hybridization: A Practical Approach, IRL Press, 1985.
Hannish, J. and M. McClelland, "Activity of DNA modification and restriction enzymes in KGB, a potassium glutamate buffer," Gene Anal. Tech 5:105 (1988.
Harris et al., "Single-molecule DNA sequencing of a viral genome." Science. Apr. 4, 2008;320(5872):106-9.
Hart et al., J.Biol.Chem., 269:62-65, 1994.
Hasan et al., Nucl. Acids Res. 24:2150-2157 (1996.
Heegaard, J Mol. Recognit. Winter; 11(1-6): 141-8 (1998).
Hennig et al (2007) J. Am. Chem. Soc. 129, 14911-14921.
Herman et al. Proc. Nat. Acad. Sci. USA 93:9821-9826, 1996.
Hershey, A. D. and Burgi, E. J. Mol. Biol, 2:143-152 (1960).
Hill, Craig, "Gen-Probe Transcription-Mediated Amplification: System Principles," Jan. 1996 httl://www.gen-probe.com/pdfs/tma_whiteppr.pdf.
HiSeq 2000 Sequencing System Specification Sheet, Illumina Inc. 2010.
Homer, J. et al., Prenat Diagn 23:566-571 (2003).
Hook, E. B. Lancet 2:169-172 (1981).
Hromandnikova, et al., "Quantification of Fetal and Total Circulatory DNA in Maternal Plasma Samples Before and After Size Fractionation by Agarose Gel Electrophoresis," DNA and Cell Biology, vol. 25, No. 11, 2006, pp. 635-640.
Hu, D. G. et al., "Aneuploidy detection in single cells using DNA array-based comparative genomic hybridization", Mol Hum Reprod 10: 283-289, (2004).
Huang et al., "Mechanism of ribose 2'-group discrimination by an RNA polymerase." Biochemistry. Jul. 8, 1997;36(27):8231-42.
Hulten et al., "Rapid and simple prenatal diagnosis of common chromosome disorders: advantages and disadvantages of the molecular methods FISH and QF-PCR." Reproduction. Sep. 2003;126(3):279-97.
Hunkapiller et al., "A microchemical facility for the analysis and synthesis of genes and proteins." Nature. Jul. 12-18, 1984;310(5973)105-11.
Hyrup et al., "Peptide nucleic acids (PNA): synthesis, properties and potential applications." Bioorg Med Chem. Jan. 1996;4(1):5-23.
Imai et al. , 1992, J. Virol. Methods 36: 181-184).
Imamura et al., "Prenatal diagnosis of adrenoleukodystrophy by means of mutation analysis." Prenat Diagn. Mar. 1996;16(3):259-61.
Innis et al., PCR Protocols: A Guide to Methods and Applications, Innis et al., eds, 1990.
Issa., "CpG island methylator phenotype in cancer." Nat Rev Cancer. Dec. 2004;4(12):988-93.
Iverson et al., 1981, Prenat. Diagn. 9: 31-48.
Iwabuchi et al., Oncogene 8: 1693-1696 (1993.
Jing et al. (1998) Proc Natl Acad Sci USA. 95(14):8046-51.
Johansen et al., "An investigation of methods for enriching trophoblast from maternal blood." Prenat Diagn. Oct. 1995;15(10):921-31.
Jurinke, C., et al., "MALDI-TOF mass spectrometry: a versatile tool for high-performance DNA analysis." Mol. Biotechnol. 26, 147-164 (2004.
Kalinina et al., "Nanoliter scale PCR with TaqMan detection." Nucleic Acids Res. May 15, 1997;25(10):1999-2004.
Kaneko et al., Gut 52:641-646 (2003).
Karlin et al., "Methods for assessing the statistical significance of molecular sequence features by using general scoring schemes." Proc Natl Acad Sci U S A. Mar. 1990;87(6):2264-8.
Kent, "BLAT—the BLAST-like alignment tool." Genome Res. Apr. 2002;12(4):656-64.
Kessel et al., "Murine developmental control genes." Science. Jul. 27, 1990;249(4967):374-9.
Kidd JM et al. Mapping and sequencing of structural variation from eight human genomes. Nature. May 1, 2008;453 (7191):56-64).
Kriegler, Gene Transfer and Expression: A Laboratory Manual (1990).
Kristensen et al., "PCR-Based Methods for Detecting Single-Locus DNA Methylation Biomarkers in Cancer Diagnostics, Prognostics, and Response to Treatement", Clinical Chemistry, Washington DC, vol. 55, No. 8., Aug. 1, 2009, pp. 1471-1483.
Kuchino et al., "Enzymatic RNA sequencing." Methods Enzymol. 1989;180:154-63.
Kuhn et al., "DNA Helicases" Cold Spring Harb Symp Quant Biol. 1979;43 Pt 1:63-7.
Kulkarmi et al., "Global DNA methylation patterns in placenta and its association with maternal hypertension in pre-eclampsia," (2011) DNA Cell Biol. 30(2):79-84.

(56) References Cited

OTHER PUBLICATIONS

Kumps et al., "RMeseuarlcthi aprtilcelex Amplicon Quantification (MAQ), a fast and efficient method for the simultaneous detection of copy number alterations in neuroblastoma," BMC Genomics 2010, 11:298, pp. 1-10.
Lai et al. (1999) Nat Genet. 23(3):309-13.
Laird, P.W. Nature Reviews Cancer 3, 253-266 (2003).
Larkin et al., "Clustal W and Clustal X version 2.0." Bioinformatics. Nov. 1, 2007;23(21):2947-8. Epub Sep. 10, 2007.
Lee et al., Fetal Nucleic Acids in Maternal Plasma, In:Fetal and Maternal Medicine Review, 2006, vol. 17,(2), pp. 125-137.
Lee TI, et al. (2006) Control of developmental regulators by Polycomb in human embryonic stem cells. Cell 125:301-313).
Leung et al., "An efficient algorithm for identifying matches with errors in multiple long molecular sequences." J Mol Biol. Oct. 20, 1991;221(4):1367-78.
Li et al. Nucl. Acids Res. 23:4495-4501 (1995).
Li et al., Dynamic Distribution of Linker Histone H1.5 in Cellular Differentiation, PLOS Genetics, vol. 8, Issue 8, e1002879, Aug. 2012, pp. 1-13.
Li et al., "Size separation of circulatory DNA in maternal plasma permits ready detection of fetal DNA polymorphisms." Clin Chem. Jun. 2004;50(6):1002-11. Epub Apr. 8, 2004.
Li et al., "Targeted mutation of the DNA methyltransferase gene results in embryonic lethality." Cell. Jun. 12, 1992;69(6):915-26.
Li, Y., et al., Genotyping fetal paternally inherited SNPs by MALDI-TOF MS using cell-free fetal DNA in maternal plasma: Influence of size fractionation. Electrophoresis 27, 3889-3896 (2006).
Lingbeek, M.E., Bruggeman, S.W. & van Lohuizen, M. Cell 118, 409-18 (2004).
Little, et al. Nat Med 3:1413-6 (1997.
Litz C. E. et al., "Methylation status of the major breakpoint cluster region in Philadelphia chromosome negative leukemias" Leukemia 6(1):35-41 (1992.
Liu et al., "Quantification of regional DNA methylation by liquid chromatography/tandem mass spectrometry", Analytical Biochemistry, Academic Press Inc, New York, vol. 391, No. 2, Aug. 15, 2009, pp. 106-113.
Liu et al., "The ribosomal small-subunit protein S28 gene from Helianthus annuus (asteraceae) is down-regulated in response to drought, high salinity, and abscisic acid," American Journal of Botany, vol. 90, No. 4., Apr. 1, 2003, pp. 526-531.
Lo et al. (Nat Med. Feb. 2007;13(2):218-23).
Lo et al., "Maternal Plasma DNA Sequencing Reveals the Genome-Wide Genetic and Mutational Profile of the Fetus," Prenatal Diagnosis, Science Translational Medicine, Dec. 8, 2010, vol. 2, Issue 61, 1-13 Lo et al. (2010).
Lo et al., "Presence of fetal DNA in maternal plasma and serum." Lancet. Aug. 16, 1997;350(9076):485-7.
Lo et al., "Quantitative analysis of fetal DNA in maternal plasma and serum: implications for noninvasive prenatal diagnosis." Am J Hum Genet. Apr. 1998;62(4):768-75.
Lo et al., Clin. Chem. 45:1747-1751, 1999.
Lo et al., Clin. Chem. 45:184-188, 1999.
Lo et al., N. Engl. J. Med. 339:1734-1738, 1998).
Lo, "Recent advances in fetal nucleic acids in maternal plasma." J Histochem Cytochem. Mar. 2005;53(3):293-6.
Lun et al., "Microfluidics digital PCR reveals a higher than expected fraction of fetal DNA in maternal plasma." Clin Chem. Oct. 2008;54(10):1664-72. Epub Aug. 14, 2008.
Lun et al., "Noninvasive prenatal diagnosis of monogenic diseases by digital size selection and relative mutation dosage on DNA in maternal plasma," PNAS, vol. 105, No. 50, Dec. 16, 2008, pp. 19920-19925.
Madura et al., J. Biol. Chem. 268: 12046-12054 (1993).
Majlessi et al., Nucleic Acids Research, 26(9):2224-2229, (1998).
Malik et al., "Polyethylene glycol (PEG)-modified granulocyte-macrophage colony-stimulating factor (GM-CSF) with conserved biological activity." Exp Hematol. Sep. 1992;20(8):1028-35.
Mann et al., "Development and implementation of a new rapid aneuploidy diagnostic service within the UK National Health Service and implications for the future of prenatal diagnosis." Lancet. Sep. 29, 2001;358(9287):1057-61.
Mann, K. Methods Mol Med 92:141-156 (2004).
Mao and Williamson (1999) Nucl. Acids Res. 27, 4059-4070.
Marais et al., EMBO J. 14: 3136-3145 (1995).
Marais et al., J. Biol. Chem. 272: 4378-4383 (1997.
Margulies et al., "Genome sequencing in microfabricated high-density picolitre reactors." Nature. Sep. 15, 2005;437(7057):376-80. Epub Jul. 31, 2005.
Mason et al., EMBO J. 18: 2137-2148 (1999.
McClelland, M. et al., "A single buffer for all restriction endonucleases," Nucl. Acids Res. 16:364 (1988).
McConnell, H. M. et al., Science 257: 1906-1912 (1992)).
Meller A. 2007 Clin Chem 53: 1996-2001.
Metzker M Nature Rev 11:31-46 (2010).
Meyers & Miller, Cabios 4:11-17 (1989).
Millipore, QIA25 Nucleosome ELISA Kit, Information Brochure, Calbiochem, Feb. 26, 2013.
Mito, Y., Henikoff, J.G. & Henikoff, S. Nat Genet 37, 1090-7 (2005.
Molecular Cloning of PCR Products, Unit 15.4, Current Protocols in Molecular Biology, (2001 John Wiley & Sons, Inc.) 15.4.1-15.4.11, Supplement 56.
Moudrianakis E. N. and Beer M. Proc Natl Acad Sci USA. Mar. 1965; 53:564-71.
Mouliere et al., "High Fragmentation Characterizes Tumour-Derived Circulating DNA," PLoS One, Sep. 2011, vol. 6, Issue 9, e23438, 1-10.
Nakamaye et al., Nucl. Acids Res. 23:9947-9959(1988).
Nakano et al. "Single-molecule PCR using water-in-oil emulsion;" Journal of Biotechnology 102 (2003) 117-124.
Needham-VanDevanter et al., "Characterization of an adduct between CC-1065 and a defined oligodeoxynucleotide duplex." Nucleic Acids Res. Aug. 10, 1984;12(15):6159-68.
Needleman et al., "A general method applicable to the search for similarities in the amino acid sequence of two proteins." J Mol Biol. Mar. 1970;48(3)444-453.
Ng et al. , 2003, Proc. Natl. Acad. Sci. USA 100 : 4748-4753.
Ng et al., 2002, Clin. Chem. 48: 1212-1217.
Nicolaides et al., "One-stop clinic for assessment of risk of chromosomal defects at 12 weeks of gestation." J Matern Fetal Neonatal Med. Jul. 2002;12(1):9-18.
Nicolaides, K. H. et al., Prenat Diagn 22:308-315 (2002)).
Nicolaidis et al., "Origin and mechanisms of non-disjunction in human autosomal trisomies." Hum Reprod. Feb. 1998;13(2):313-9.
Nishizuka et al., "Proteomic profiling of the NCI-60 cancer cell lines using new high-density reverse-phase lysate microarrays." Proc Natl Acad Sci U S A. Nov. 25, 2003;100(24):14229-34. Epub Nov. 17, 2003.
Nolte, "Branched DNA signal amplification for direct quantitation of nucleic acid sequences in clinical specimens." Adv Clin Chem. 1998;33:201-35.
Nosaka, K. et al., "Increasing methylation of the CDKN2A gene is associated with the progression of adult T-cell leukemia", Cancer Res. 60(4):1043-1048 (2000).
Nygren et al., "Quantification of Fetal DNA by Use of Methylation-Based DNA Discrimination," Clinical Chemistry, 56:10, pp. 1627-1635.
Oefner, P. J. et al., "Efficient random subcloning of DNA sheared in a recirculating point-sink flow system," Nucl. Acids Res. 24(20):3879-3886 (1996).
Oeth et al., "Qualitative and quantitative genotyping using single base primer extension coupled with matrix-assisted laser desorption/ionization time-of-flight mass spectrometry (MassARRAY)." Methods Mol Biol. 2009;578:307-43.
Oeth, P. et al., (iPLEX™ Assay: Increased Plexing Efficiency and Flexibility for MassARRAY® System through single base primer extension with mass-modified Terminators. SEQUENOM Application Note (2005).
Ohm, J.E. et al. A stem cell-like chromatin pattern may predispose tumor suppressor genes to DNA hypermethylation and heritable silencing. Nat Genet 39, 237-42 (2007).

(56) References Cited

OTHER PUBLICATIONS

Ohtsuka et al., J. Biol. Chem. 260:2605-2608 (1985).
Okano et al., "DNA methyltransferases Dnmt3a and Dnmt3b are essential for de novo methylation and mammalian development." Cell. Oct. 29, 1999;99(3):247-57.
Old RW, "Candidate epigenetic biomarkers for non-invasive prenatal diagnosis of Down syndrom," Reprod Biomed. Online 2007, vol. 15, No. 2, pp. 227-235.
Olek et al., "A modified and improved method for bisulphite based cytosine methylation analysis." Nucleic Acids Res. Dec. 15, 1996;24(24):5064-6.
Oligonucleotides and Analogues, A Practical Approach, F. Eckstein, editor, IRL Press, Oxford, 1991.
Orita et al., Proc. Natl. Acad. Sci. U.S.A 86: 27776-2770 (1989.
Osborne, et al., Curr. Opin. Chem. Biol.1(1): 5-9 (1997.
Oudejans et al., 2003, Prenatal Diagnosis 23: 111-116.
Padilla et al., "Efficient synthesis of nucleic acids heavily modified with non-canonical ribose 2'-groups using a mutantT7 RNA polymerase (RNAP)." Nucleic Acids Res. Mar. 15, 1999;27(6):1561-3.
Palomaki et al., "Maternal serum screening for Down syndrome in the United States: a 1995 survey." Am J Obstet Gynecol. May 1997;176(5):1046-51.
Pandya et al., "Screening for fetal trisomies by maternal age and fetal nuchal translucency thickness at 10 to 14 weeks of gestation." Br J Obstet Gynaecol. Dec. 1995;102(12):957-62.
Patel, D. J., Curr. Opin. Chem. Biol. Jun;1(1): 32-46 (1997).
Paulin, R. et al. in Nucleic Acids Res. 26:5009-5010, 1998.
Pearson & Reanier, J. Chrom. 255: 137-149 (1983).
Pearson, 1988, Proc. Natl. Acad. Sci. USA 85(5): 2444-2448.
Perry-O'Keefe et al., "Peptide nucleic acid pre-gel hybridization: an alternative to southern hybridization." Proc Natl Acad Sci U S A. Dec. 10, 1996;93(25):14670-5.
Pertl et al., "Rapid molecular method for prenatal detection of Down's syndrome." Lancet. May 14, 1994;343(8907):1197-8.
Peters et al., "Noninvasive Prenatal Diagnosis of a Fetal Microdeletion Syndrome," New England Journal of Medicine, Nov. 10, 2011, pp. 1847-1848.
Petersen and Mikkelsen. Cytogenet Cell Genet. 2000;91(1-4):199-203.
Pinkert et al., Genes Dev. 1: 268-277 (1987).
Poon et al. , 2000, Clin. Chem. 46: 1832-1834.
Poon et al., "Differential DNA methylation between fetus and mother as a strategy for detecting fetal DNA in maternal plasma." Clin Chem. Jan. 2002;48(1):35-41.
Porter et al., Biochemistry 34: 11963-11969 (1995).
Qu et al., "Analysis of drug-DNA binding data." Methods Enzymol. 2000;321:353-69.
Queen et al., "Immunoglobulin gene transcription is activated by downstream sequence elements." Cell. Jul. 1983;33(3):741-8.
Radding., "Homologous pairing and strand exchange in genetic recombination." Annu Rev Genet. 1982;16:405-37.
Randen et al., "Prenatal genotyping of RHD and SRY using maternal blood," VOX SANGUINIS, vol. 85, No. 4, Nov. 2003, pp. 300-306.
Rashtchian (1994, PCR Methods Applic. 4: S83-S91).
Rivas, G., and Minton, A. P., Trends Biochem Sci Aug;18(8): 284-7 (1993).
Robertson et al., Nature Rev. Genet. 1:11-19 (2000).
Robinson M. D. and T. P. Speed. "A comparison of Affymetrix gene expression arrays." BMC Bioinformatics 8:449 (2007).
Rojo et al., "Cusativin, a new cytidine-specific ribonuclease accumulated in seeds of *Cucumis sativus* L." Planta. 1994;194(3):328-38.
Rollins et al., "Large-scale structure of genomic methylation patterns." Genome Res. Feb. 2006;16(2):157-63. Epub Dec. 19, 2005.
Romero and Rotbard, Diagnostic Molecular Biology: Principles and Applications, pp. 401-406; Pershing et al, eds., Mayo Foundation, Rochester, Minn., 1993.
Roschke et al., "Karyotypic complexity of the NCI-60 drug-screening panel." Cancer Res. Dec. 15, 2003;63(24):8634-47.
Rosenberg, H. S. and Bendich, A. J. Am. Chem. Soc. 82:3198-3201 (1960).
Rossolini et al., Mol. Cell. Probes 8:91-98 (1994).
Sadri & Hornsby (Nucl. Acids Res. 24:5058-5059, 1996.
Saito et al., Lancet 356:1170, 2000.
Salgame et al., "An ELISA for detection of apoptosis," Nucleic Acids Research, 1997, vol. 25, No. 3, pp. 680-681.
Sambrook et al., Molecular Biology: A laboratory Approach, Cold Spring Harbor, N. Y. 1989.
Sanchez et al, "Effects of Sulpiride on Prolactin and mRNA Levels of Steroid 5a-reductase Isozymes in Adult Rat Brain," Neurochem Res (2008) 33:820-825.
Santoro, S. W. and Joyce, G. F. "A general purpose RNA-cleaving DNA enzyme," Proc. Natl. Acad. Sci. USA 94:4262-4266 (1997.
Sargent et al., Meth. Enz. 152:432 (1988)).
Schlesinger et al., "Polycomb-mediated methylation on Lys27 of histone H3 pre-marks genes for de novo methylation in cancer." Nat Genet. Feb. 2007;39(2):232-6. Epub Dec. 31, 2006.
Schouten et al., "Relative quantification of 40 nucleic acid sequences by multiplex ligation-dependent probe amplification." Nucleic Acids Res. Jun. 15, 2002;30(12):e57.
Schriefer, L. A. et al., "Low pressure DNA shearing: a method for random DNA sequence analysis," Nucl. Acids Res. 18:7455-7456 (1990.
Schuler GD, Sequence mapping by electronic PCR., Genome Res. May 1997;7(5):541-50.
Scott et al. (2004) J. Am. Chem. Soc. 126, 11776-11777.
Sekizawa et al., Clin. Chem. 47:2164-2165, 2001.
Sheffield et al., "Identification of novel rhodopsin mutations associated with retinitis pigmentosa by GC-clamped denaturing gradient gel electrophoresis." Am J Hum Genet. Oct. 1991;49(4):699-706.
Silverman et al., "Methylation inhibitor therapy in the treatment of myelodysplastic syndrome." Nat Clin Pract Oncol. Dec. 2005;2 Suppl 1:S12-23.
Simoncsits et al., "New rapid gel sequencing method for RNA." Nature. Oct. 27, 1977;269(5631):833-6.
Singer et al., Biotechniques 4:230, 1986.
Sjolander & Urbaniczk, Anal. Chem. 63: 2338-2345 (1991.
Slater et al., "Rapid, high throughput prenatal detection of aneuploidy using a novel quantitative method (MLPA)." J Med Genet. Dec. 2003;40(12):907-12.
Smith et al., "Identification of common molecular subsequences." J Mol Biol. Mar. 25, 1981;147(1):195-7.
Smith et al., "Single-step purification of polypeptides expressed in *Escherichia coli* as fusions with glutathione S-transferase." Gene. Jul. 15, 1988;67(1):31-40.
Snijders et al., "Assembly of microarrays for genome-wide measurement of DNA copy number." Nat Genet. Nov. 2001;29(3):263-4.
Snijders et al., "First-trimester ultrasound screening for chromosomal defects." Ultrasound Obstet Gynecol. Mar. 1996;7(3):216-26.
Snijders et al., "UK multicentre project on assessment of risk of trisomy 21 by maternal age and fetal nuchal-translucency thickness at 10-14 weeks of gestation. Fetal Medicine Foundation First Trimester Screening Group." Lancet. Aug. 1, 1998;352(9125):343-6.
Soni et al., "Progress toward ultrafast DNA sequencing using solid-state nanopores." Clin Chem. Nov. 2007;53(11):1996-2001. Epub Sep. 21, 2007.
Sousa et al., "A mutant T7 RNA polymerase as a DNA polymerase." EMBO J. Sep. 15, 1995;14(18):4609-21.
Spetzler et al, Enriching for Rare Subpopulations of Circulating Microvesicles by the Depletion of Endothelial-and Leukocyte-Derived Microvesicles, CARIS Life Sciences, Carisome Posters, Papers, Abstracts and Presentations, American Academy of Cancer Research (AACR 2011).
Stanssens et al., "High-throughput MALDI-TOF discovery of genomic sequence polymorphisms." Genome Res. Jan. 2004;14(1):126-33.
Staunton et al., "Chemosensitivity prediction by transcriptional profiling." Proc Natl Acad Sci U S A. Sep. 11, 2001;98(19)10787-92.
Staunton, J.E. et al. Proc Natl Acad Sci U S A 98, 10787-92 (2001).

(56) References Cited

OTHER PUBLICATIONS

Strathdee, et al., Am. J. Pathol. 158:1121-1127 (2001).
Strohmeier, Fred, "A New High-Performance Capillary Electrophoresis Instrument," 10-19, Hewlett-Packard Journal, Jun. 1995.
Szabo et al., Curr. Opin. Struct. Biol. 5: 699-705 (1995).
Takai et al., Proc. Natl. Acad. Sci. U.S.A. 99:3740-3745, 2002).
Tang et al. (2002) Analytical Chemistry 74, 226-331.
Terme et al. "Histone H1 Variants Are Differentially Expressed and Incorporated into Chromatin during Differentiation and Reprogramming to Pluripotency," The Journal of Clinical Chemistry, vol. 286, No. 41, Oct. 14, 2011, pp. 35347-35357.
The Cancer Test, Cell Free DNA, 2007, Health Screen Inc. printed from the internet on Mar. 20, 2011 (http://www.thecancertest.com/science-of-cell-free-dna/.
The Human Genome, T. Strachan, BIOS Scientific Publishers, 1992.
The World Health Organization histological typing of lung tumours, Am J Clin Pathol 1982; 77:123-136.
Thorstenson, Y.R. et al., "An Automated Hydrodynamic Process for Controlled, Unbiased DNA Shearing," Genome Research 8:848-855 (1998).
Tolbert and Williamson (1996) J. Am. Chem. Soc. 118, 7929-7940.
Tolbert and Williamson (1997) J. Am. Chem. Soc. 119, 12100-12108.
Tong et al., "Noninvasive Prenatal Detection of Fetal Trisomy 18 by Epigenetic Allelic Ratio Analysis in Maternal Plasma: Theoretical and Empirical Considerations," Clinical Chemistry 52:12, pp. 2149-2202.
Tooke N and Pettersson M. IVDT. Nov. 2004; 41.
Tost et al., Nucl. Acids Res. 37:e50 (2003).
Toyota et al., "Methylation profiling in acute myeloid leukemia." Blood. May 1, 2001;97(9):2823-9.
Toyota et al., Cancer Res. 59:2307-12, 1999.
Tungwiwat et al., "Non-invasive fetal sex determination using a conventional nested PCR analysis of fetal DNA in maternal plasma," Clinica Chimica Acta, vol. 334, No. 1-2, Aug. 2003, pp. 173-177.
Tynan et al., "Fractional DNA quantification by massively parallel shotgun sequencing-implications for fetal fraction measurement in maternal plasma," (Sequenom MME) ASHG Poster, 2011.
Uhlmann, K. et al. Electrophoresis 23:4072-4079 (2002.
Valk et al., "Prognostically useful gene-expression profiles in acute myeloid leukemia." N Engl J Med. Apr. 15, 2004;350(16):1617-28.
Valk-Lingbeek et al., "Stem cells and cancer; the polycomb connection." Cell. Aug. 20, 2004;118(4):409-18.
Van der Schoot, C.E., et al., Real-time PCR of bi-allelic insertion/deletion polymorphisms can serve as a reliable positive control for cell-free fetal DNA in non-invasive prenatal genotyping [abstract] Blood 102, 93a (2003).
Veltman et al., "High-throughput analysis of subtelomeric chromosome rearrangements by use of array-based comparative genomic hybridization." Am J Hum Genet. May 2002;70(5):1269-76. Epub Apr. 9, 2002.
Venter et al., "The sequence of the human genome." Science. Feb. 16, 2001;291(5507):1304-51.
Verbeck et al. in the Journal of Biomolecular Techniques (vol. 13, Issue 2, 56-61).
Verma et al., "Rapid and simple prenatal DNA diagnosis of Down's syndrome." Lancet. Jul. 4, 1998;352(9121):9-12.
Vincenet et al., "Helicase-Dependent isothermal DNA Amplification," EMBO reports 5(8):795-800 (2004).
Vire et al., "The Polycomb group protein EZH2 directly controls DNA methylation." Nature. Feb. 16, 2006;439(7078):871-4. Epub Dec. 14, 2005.
Vogelstein et al., "Digital PCR." Proc Natl Acad Sci U S A. Aug. 3, 1999;96(16):9236-41.
Volkerding et al. Clin Chem 55:641-658 (2009).
Vu et al. "Symmetric and asymmetric DNA methylation in the human IGF2-H19 imprinted region," Genomics, Mar. 1;64(2):132-143. (2000).
Wada et al., "Codon usage tabulated from the GenBank genetic sequence data." Nucleic Acids Res. May 11, 1992;20 Suppl:2111-8.
Wald and Hackshaw, Prenat Diagn 17(9):821-829 (1997).
Wang, H. et al. BMC Genomics 7, 166 (2006.
Wapner et al., "First-trimester screening for trisomies 21 and 18." N Engl J Med. Oct. 9, 2003;349(15):1405-13.
Waterman et al., 1980, J. Mol. Biol. 147: 195-197.
Weber et al., Oncogene 19: 169-176 (2000.
Weisenberger, D.J. et al. Nat Genet 38, 787-93 (2006.
Weiss et al., "H1 variant-specific lysine methylation by G9a/KMT1C and Glp1/KMT1D," Epigenetics & Chromatin Mar. 24, 2010, 3:7, pp. 1-13.
White et al., "Detecting single base substitutions as heteroduplex polymorphisms." Genomics. Feb. 1992;12(2):301-6.
Widschwendter, M. et al. Epigenetic stem cell signature in cancer. Nat Genet 39, 157-8 (2007).
Wilkinson, In situ Hybridization, Wilkinson ed., IRL Press, Oxford University Press, Oxford 1998.
Winoto et al., "A novel, inducible and T cell-specific enhancer located at the 3' end of the T cell receptor alpha locus." EMBO J. Mar. 1989;8(3):729-33.
Xiong & Laird, Nucleic Acids Res. 25:2532-2534, 1997.
Yamada et al. (Genome Research 14:247-266, 2004).
Yan et al., "A novel diagnostic strategy for trisomy 21 using short tandem repeats," Electrophoresis 2006, 27,416-422.
Zahra S, et al, Plasma microparticles are not elevated in fresh plasma from patients with gynaecologicalmalignancy—An observational study, Gynecol Onco, Oct. 2011;123(1):152-156.
Zervos et al., Cell 72:223-232 (1993.
Zhang et al., "Histone H1 Depletion Impairs Embryonic Stem Cell Differentiation," PLOS Genetics, vol. 8, Issue 5, e1002691, May 2012, pp. 1-14.
Zhao et al., (2010) Pretat Diag 30(8):778-782.
Zheng et al., "Nonhematopoietically Derived DNA Is Shorter than Hematopoietically Derived DNA in Plasma: A Transplantation Model," Clin Chem 58:2, Nov. 3, 2011.
Zhong et al., Am. J. Obstet. Gynecol. 184:414-419, 2001).
Zhong et al., Prenat. Diagn. 20:795-798, 2000.
Zimmermann Lecturer, et al., 'Serum parameters and nuchal translucency in first trimester screening for fetal chromosomal abnormalities', In: BJOG: An International Journal of Obstetrics & Gynaecology, 1996, vol. I03(1O), pp. 1009-1014.
Zimmermann, B. et al. Clin Chem 48:362-363 (2002).
Zuker "Mfold web server for nucleic acid folding and hybridization prediction," Nucleic Acids Res. 31(13), 3406-3415.
Supplementary European Search Report dated Jul. 14, 2011 for European Application No. EP 09720284 filed: Mar. 10, 2009 based on international application No. PCT/US2009/036683.
Extended European Search Report dated Jan. 4, 2012 in European Application No. EP10817598.5 filed: Mar. 18, 2010.
Extended European Search Report dated Apr. 22, 2013 in European Application No. EP10843520 filed: Dec. 20, 2010 based on International Application No. PCT/US2010/061319.
International Preliminary Report on Patentability dated Sep. 3, 2009 in International Application No. PCT/US2008/54468 filed on Feb. 20, 2008.
International Search Report and Written Opinion dated Sep. 23, 2008 in International Application No. PCT/US2008/54468 filed on Feb. 20, 2008.
International Preliminary Report on Patentability dated Feb. 18, 2010 in International Application No. PCT/US2008/54470 filed on Feb. 20, 2008.
International Search Report and Written Opinion dated Aug. 18, 2008 in International Application No. PCT/US2008/54470 filed on Feb. 20, 2008.
International Preliminary Report on Patentability dated Dec. 30, 2009 in International Application No. PCT/US2008/066791 filed on Jun. 12, 2008.
International Search Report and Written Opinion dated Dec. 22, 2008 in International Application No. PCT/US2008/066791 filed on Jun. 12, 2008.

(56) References Cited

OTHER PUBLICATIONS

International Search Report and Written Opinion, dated Feb. 24, 2010 in International application No. PCT/US2009/036683 filed on: Mar. 10, 2009 and published as WO 09/114543 on Sep. 17, 2009.
Invitation to Pay Additional Fees and Partial International Search Report dated Dec. 28, 2009 in International application No. PCT/US2009/036683 filed on: Mar. 10, 2009 and published as WO 09/114543 on Sep. 17, 2009.
International Preliminary Report on Patentability, dated Sep. 23, 2010 in International application No. PCT/US2009/036683 filed on: Mar. 10, 2009 and published as WO 09/114543 on Sep. 17, 2009.
International Preliminary Report on Patentability dated Mar. 31, 2011 in International Application No. PCT/US2009/057215 filed on Sep. 16, 2009 and published as: WO 10/033639 on Mar. 25, 2010.
International Search Report and Written Opinion dated Dec. 29, 2010 in International Application No. PCT/US2009/057215 filed on Sep. 16, 2009 and published as: WO 10/033639 on Mar. 25, 2010.
International Search Report and Written Opinion dated Dec. 30, 2010 in International Application No. PCT/US2010/027879 filed on Mar. 18, 2010.
International Preliminary Report on Patentability dated Mar. 29, 2012 in International Application No. PCT/US2010/027879 filed on Mar. 18, 2010.
International Preliminary Report on Patentability dated Jul. 5, 2012 in International Application No. PCT/US2010/061319 filed on Dec. 20, 2010.
International Search Report and Written Opinion dated Sep. 21, 2011 in International Application No. PCT/US2010/061319 filed on Dec. 20, 2010.
International Search Report and Written Opinion dated Jan. 10, 2012 in International Application No. PCT/US2012/035479 filed on Apr. 27, 2012.
Office Action dated Mar. 18, 2013 in U.S. Appl. No. 12/401,493, filed Mar. 10, 2009 and published as: 2009/0317817 on: Dec. 24, 2009.
Office Action dated Jul. 19, 2011 in U.S. Appl. No. 12/401,493, filed Mar. 10, 2009 and published as: 2009/0317817 on: Dec. 24, 2009.
Office Action dated Oct. 28, 2010 in U.S. Appl. No. 12/401,493, filed Mar. 10, 2009 and published as: 2009/0317817 on: Dec. 24, 2009.
Office Action dated Feb. 27, 2013 in U.S. Appl. No. 12/561,241, filed Sep. 16, 2009.
Office Action dated Jun. 15, 2012 in U.S. Appl. No. 12/561,241, filed Sep. 16, 2009.
Office Action dated Apr. 5, 2013 in U.S. Appl. No. 13/495,975, filed Jun. 13, 2012.
Office Action dated Apr. 5, 2013 in U.S. Appl. No. 13/517,532, filed Jun. 13, 2012.
Office Action dated Apr. 12, 2013 in U.S. Appl. No. 12/727,198, filed Mar. 18, 2010.
Office Action dated Jan. 28, 2013 in U.S. Appl. No. 13/457,978, filed Apr. 27, 2012 and published as: 2012/0276542 on: Oct. 1, 2012.
Office Action dated Sep. 17, 2012 in U.S. Appl. No. 13/457,978, filed Apr. 27, 2012 and published as: 2012/0276542 on: Oct. 1, 2012.
Office Action dated Feb. 6, 2013 in U.S. Appl. No. 13/458,036, filed Apr. 27, 2012 and published as: 2012/0264618 on: Oct. 18, 2012.
Office Action dated Sep. 24, 2012 in U.S. Appl. No. 13/458,036, filed Apr. 27, 2012 and published as: 2012/0264618 on: Oct. 18, 2012.
Office Action dated Feb. 5, 2013 in U.S. Appl. No. 13/458,341, filed Apr. 27, 2012.
Office Action dated Sep. 17, 2012 in U.S. Appl. No. 13/458,341, filed Apr. 27, 2012.
Fan et al., "Analysis of the size distributions of fetal and maternal cell-free DNA by paired-end sequencing" Clinical Chemistry (2010) 56(8):1279-1286.
Office Action dated Jun. 26, 2014 in U.S. Appl. No. 13/782,857, filed Mar. 1, 2013 and published as US 2013-0310260 on Nov. 21, 2013.
Office Action dated Feb. 5, 2014 in U.S. Appl. No. 13/517,508, filed Jun. 13, 2012 and published as US 2013-0143211 on Jun. 6, 2013.
Office Action dated Mar. 7, 2014 in U.S. Appl. No. 13/801,384, filed Mar. 13, 2013 and published as US 2013-0296180 on Nov. 7, 2013.
Extended European Search Report dated Aug. 19, 2016 in European Patent Application No. 16156605.4, filed on Dec. 20, 2010.

\* cited by examiner

FIGURE 1

Identify sequences that are almost identical between two chromosomes (paralogs)

Mismatch 1 / chr 21  ACCCACACAGTGGGCTTGGTGACATCCTAGGATT[T]TATTC CACCC CTAGAATCCAACCT TT CCT
Mismatch 2 / chr 14  TGGGTGTCACCCGAACCACTGTAGGATCCTAAACTA[G]ATAAGGTGGGATCTTAGGTTGGAAGGA Normal:
1000 copies A1 maternal
1000 copies A2 maternal
100 copies A1 fetal
100 copies A2 fetal
Total copies A1: 1100
Total copies A2: 1100
Ratio: 1:1 / 50%

T21:
1000 copies A1 maternal
1000 copies A2 maternal
150 copies A1 fetal
100 copies A2 fetal
Total copies A1: 1150
Total copies A2: 1100
Ratio: 1.045:1 / 51%

FIGURE 7
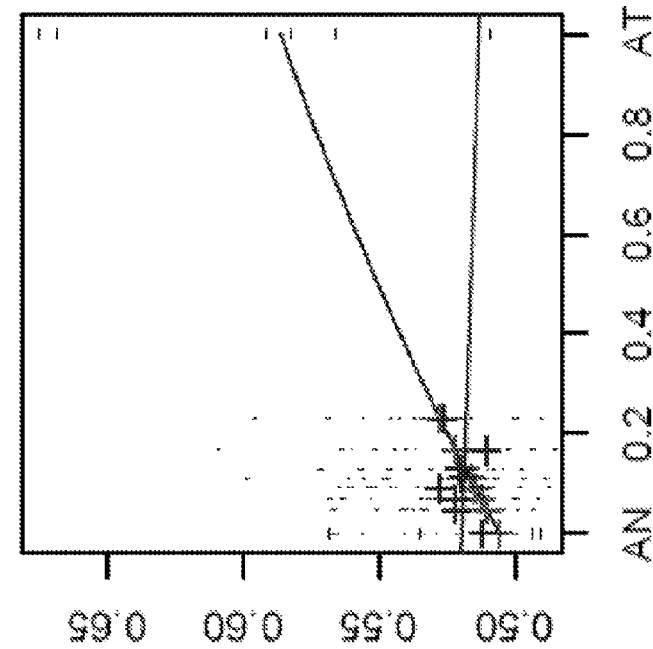
GOOD ASSAY
- Linear response
- good match of expected vs. observed
- Large Difference between N00 and N30
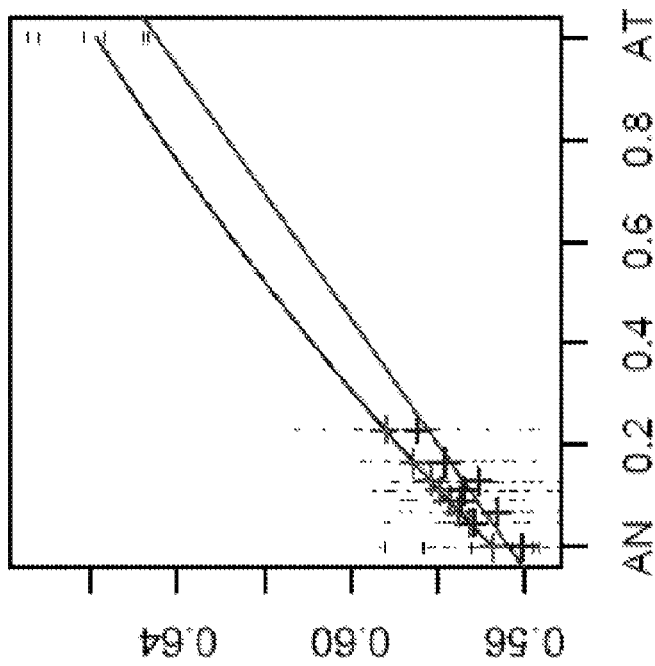
POOR ASSAY
- NO Linear response
- NO difference between N00 and N30
- Large technical variance

PROCESSES AND KITS FOR IDENTIFYING ANEUPLOIDY

RELATED PATENT APPLICATION(S)

This application is a national stage of international patent application no. PCT/US2010/061319 filed on Dec. 20, 2010, entitled PROCESSES AND KITS FOR IDENTIFYING ANEUPLOIDY, naming Mathias Ehrich, Guy Del Mistro, Cosmin Deciu, Yong Qing Chen, Ron Michael McCullough and Roger Chan Tim as applicants and inventors, which claims the benefit of U.S. provisional patent application No. 61/289,370 filed on Dec. 22, 2009, entitled PROCESSES AND KITS FOR IDENTIFYING ANEUPLOIDY, naming Mathias Ehrich, Guy Del Mistro, Cosmin Deciu, Yong Qing Chen, Ron Michael McCullough and Roger Chan Tim as inventors. The entire content of the foregoing patent application is incorporated herein by reference, including, without limitation, all text, tables and drawings.

SEQUENCE LISTING

The instant application contains a Sequence Listing which has been submitted electronically in ASCII format and is hereby incorporated by reference in its entirety. Said ASCII copy, created on Jun. 26, 2014, is named SEQ-6027-US_SL.txt and is 5,172,775 bytes in size.

FIELD

The technology in part relates to methods and compositions for identifying a chromosome abnormality, which include, without limitation, prenatal tests for detecting an aneuploidy (e.g., trisomy 21 (Down syndrome), trisomy 18 (Edward syndrome), trisomy 13 (Patau syndrome)).

BACKGROUND

A chromosome is an organized structure of deoxyribonucleic acid (DNA) and protein found in cells. A chromosome generally includes a single piece of DNA that contains many genes, regulatory elements and other nucleotide sequences. Most cells in humans and other mammals typically include two copies of each chromosome.

Different organisms include different numbers of chromosomes. Most feline cells include nineteen (19) pairs of chromosomes and most canine cells include thirty-nine (39) pairs of chromosomes. Most human cells include twenty-three (23) pairs of chromosomes. One copy of each pair is inherited from the mother and the other copy is inherited from the father. The first twenty-two (22) pairs of chromosomes (referred to as autosomes) are numbered from 1 to 22, and are arranged from largest to smallest in a karyotype. The twenty-third ($23^{rd}$) pair of chromosomes is a pair of sex chromosomes. Females typically have two X chromosomes, while males typically have one X chromosome and one Y chromosome.

Chromosome abnormalities can occur in different forms. Aneuploidy is an abnormal number of certain chromosomes in cells of an organism. There are multiple mechanisms that can give rise to aneuploidy, and aneuploidy can occur within cancerous cells or fetal cells, for example. Many fetuses with aneuploid cells do not survive to term. Where a fetus having aneuploid cells does survive to term, the affected individual is at risk of certain diseases and syndromes, including cancer and others described herein.

An extra or missing chromosome is associated with a number of diseases and syndromes, including Down syndrome (trisomy 21), Edward syndrome (trisomy 18) and Patau syndrome (trisomy 13), for example. Incidence of trisomy 21 is estimated at 1 in 600 births and increases to 1 in 350 in women over the age of 35. Down syndrome presents as multiple dysmorphic features, including physical phenotype, mental retardation and congenital heart defects (e.g., in about 40% of cases). Incidence of trisomy 18 is estimated at 1 in 80,000 births, increasing to 1 in 2,500 births in women over the age of 35. Edward syndrome also presents as multiple dysmorphic features and profound mental deficiency. Open neural tube defects or open ventral wall defects present in about 25% of cases and there is a 90% fatality rate in the first year. Incidence of trisomy 13 is estimated in 1 in 10,000 live births, and presents heart defects, brain defects, cleft lip and cleft palate, visual abnormalities (e.g., omphalocele, proboscis and holoprosencephaly) for example. More than 80% of children with trisomy 13 die in the first month of life.

Aneuploidy in gestating fetuses can be diagnosed with relative accuracy by karyotyping and fluorescent in situ hybridization (FISH) procedures. Such procedures generally involve amniocentesis and chorionic villus sampling (CVS), both relatively invasive procedures, followed by several days of cell culture and a subjective analysis of metaphase chromosomes. There also is a non-trivial risk of miscarriage associated with these procedures. As these procedures are highly labor intensive, certain procedures that are less labor intensive have been proposed as replacements. Examples of potentially less labor intensive procedures include detection using short tandem repeats, PCR-based quantification of chromosomes using synthetic competitor template and hybridization-based methods.

SUMMARY

Current methods of screening for trisomies include serum testing and may also include a Nuchal Translucency (NT) Ultrasound. If the calculated risk analysis is high, the patient may be referred for an amniocentesis or CVS for confirmation. However, the standard of care in the United States and Europe typically can achieve an 80-85% detection rate with a 4-7% false positive rate. As a result, many patients are being unnecessarily referred to invasive amniocentesis or CVS procedures. Amniocentesis involves puncturing the uterus and the amniotic sac and increases risk of miscarriage, and fetal cells obtained by amniocentesis often are cultured for a period of time to obtain sufficient fetal cells for analysis.

Technology described herein provides non-invasive methods for detecting the presence or absence of a chromosome abnormality by analyzing extracellular nucleic acid (e.g., nucleic acid obtained from an acellular sample). Methods described herein also offer increased sensitivity and specificity as compared to current non-invasive procedures (e.g., serum screening).

Determining whether there is a chromosome abnormality when analyzing cell-free nucleic acid can present challenges because there is non-target nucleic acid mixed with target nucleic acid. For example, extracellular nucleic acid obtained from a pregnant female for prenatal testing includes maternal nucleic acid background along with the target fetal nucleic acid. Technology described herein provides methods for accurately analyzing extracellular nucleic acid for chromosome abnormalities when a background of non-target nucleic acid is present.

Thus, provided herein are methods for identifying the presence or absence of a chromosome abnormality in a subject, which comprise: (a) preparing a plurality of sets of amplified nucleic acid species by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and (b) determining the amount of each amplified nucleic acid species in each set; whereby the presence or absence of the chromosome abnormality is identified based on the amount of the amplified nucleic acid species from two or more sets.

Also provided herein are methods for identifying the presence or absence of a chromosome abnormality in a subject, which comprise: (a) preparing a plurality of sets of amplified nucleic acid species by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set by a single set of amplification primers, (v) and each amplified nucleic acid species in a set comprises a nucleotide sequence having the one or more mismatch nucleotides; and (b) determining the amount of each amplified nucleic acid species in each set; whereby the presence or absence of the chromosome abnormality is identified based on the amount of the amplified nucleic acid species from two or more sets. In another embodiment, amplification primers are modified or otherwise different from each other and yield amplification products at reproducible levels relative to each other.

Also provided herein are methods for identifying the presence or absence of an abnormality of a target chromosome in a subject, which comprise: (a) preparing three or more sets of amplified nucleic acid species by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences of each nucleotide sequence in a set in the extracellular nucleic acid template are substantially identical; and (vii) each amplified nucleic acid species in a set comprises a nucleotide sequence having the one or more mismatch nucleotides; and (b) determining the amount of each amplified nucleic acid species in each set; (c) detecting the presence or absence of a decrease or increase of the target chromosome from the amount of each amplified nucleic acid species in the sets; whereby the presence or absence of the chromosome abnormality is identified based on a decrease or increase of the target chromosome relative to the one or more reference chromosomes. In a related embodiment, the three or more sets of amplified nucleic acid species are amplified in a single, multiplexed reaction. In another embodiment, the amount of each amplified nucleic acid species in each set is determined in a single, multiplexed reaction. In another embodiment, the amount of each amplified nucleic acid species in each set is determined in two or more replicated multiplexed reactions. In yet another embodiment, detecting the presence or absence of a decrease or increase of the target chromosome from the amount of each amplified nucleic acid species in the sets; whereby the presence or absence of the chromosome abnormality is identified based on a decrease or increase of the target chromosome relative to the one or more reference chromosomes.

Provided also herein are methods for identifying the presence or absence of a chromosome abnormality in a subject, which comprise: (a) preparing a set of amplified nucleic acid species by amplifying nucleotide sequences from extracellular nucleic acid template of a subject, where: (i) the extracellular nucleic acid template is heterogeneous, (ii) each nucleotide sequence in the set is present on three or more different chromosomes, (iii) each nucleotide sequence in the set differs by one or more mismatch nucleotides from each other nucleotide sequence in the set; (iv) each nucleotide sequence in the set is amplified at a substantially reproducible level relative to each other nucleotide sequence in the set, (v) the primer hybridization sequences in the extracellular nucleic acid template are substantially identical; and (vi) each amplified nucleic acid species in the set comprises a nucleotide sequence having the one or more mismatch nucleotides; and (b) determining the amount of each amplified nucleic acid species in the set; whereby the presence or absence of the chromosome abnormality is identified based on the amount of the amplified nucleic acid species.

Also provided are methods for identifying the presence or absence of a chromosome abnormality in a subject, which comprise: (a) preparing a set of amplified nucleic acid species by amplifying nucleotide sequences from extracellular nucleic acid template of a subject, where: (i) the extracellular nucleic acid template is heterogeneous, (ii) each nucleotide sequence in the set is present on chromosome 21, chromosome 18 and chromosome 13, (iii) each nucleotide sequence in the set differs by one or more mismatch nucleotides from each other nucleotide sequence in the set; (iv) each nucleotide sequence in the set is amplified at a substantially reproducible level relative to each other nucleotide sequence in the set, (v) the primer hybridization sequences in the extracellular nucleic acid template are substantially identical; and (vi) each amplified nucleic acid species in the set comprises a nucleotide sequence having the one or more mismatch nucleotides; and (b) determining the amount of each amplified nucleic acid species in each set; whereby the presence or absence of the chromosome abnormality is identified based on the amount of the amplified nucleic acid species in the set. In certain embodiments, two or more sets of nucleotide sequence species, and amplified nucleic acid species generated there from, are utilized.

In some embodiments, the chromosome abnormality is aneuploidy of a target chromosome, and in certain embodiments, the target chromosome is chromosome 21, chromosome 18, chromosome 13, chromosome X and/or chromosome Y. In some embodiments each nucleotide sequence in a set is not present in any chromosome other than in each and every target chromosome.

The template nucleic acid is from blood, in some embodiments, and sometimes the blood is blood plasma, blood serum or a combination thereof. The extracellular nucleic acid sometimes comprises a mixture of nucleic acid from cancer cells and nucleic acid from non-cancer cells. In some embodiments, the extracellular nucleic acid comprises a mixture of fetal nucleic acid and maternal nucleic acid. Sometimes the blood is from a pregnant female subject is in the first trimester of pregnancy, the second trimester of pregnancy, or the third trimester of pregnancy. In some embodiments, the nucleic acid template comprises a mixture of maternal nucleic acid and fetal nucleic acid, and the fetal nucleic acid sometimes is about 5% to about 40% of the nucleic acid. In some embodiments the fetal nucleic acid is about 0.5% to about 4.99% of the nucleic acid. In certain embodiments the fetal nucleic acid is about 40.01% to about 99% of the nucleic acid. In some embodiments, a method described herein comprises determining the fetal nucleic acid concentration in the nucleic acid, and in some embodiments, the amount of fetal nucleic acid is determined based on a marker specific for the fetus (e.g., specific for male fetuses). The amount of fetal nucleic acid in the extracellular nucleic acid can be utilized for the identification of the presence or absence of a chromosome abnormality in certain embodiments. In some embodiments, fetal nucleic acid of the extracellular nucleic acid is enriched, by use of various enrichment methods, relative to maternal nucleic acid.

Each nucleotide sequence in a set is substantially identical to each other nucleotide sequence in the set, in some embodiments. In certain embodiments, each nucleotide sequence in a set is a paralog sequence, and sometimes each nucleotide sequence in each set shares about 50%, 60%, 70%, 80%, 90%, 91%, 92%, 93%, 94%, 95%, 96%, 97%, 98% or 99% identity with another nucleotide sequence in the set. In some embodiments, each nucleotide sequence in a set differs by one or more nucleotide base mismatches (e.g., about 1, 2, 3, 4, 5, 6, 7, 8, 9 or 10 mismatch differences). In certain embodiments, the one or more nucleotide base mismatches are polymorphisms (e.g., SNPs, insertions or deletions) with a low heterozygosity rate (e.g., less than 5%, 4%, 3%, 2%, 1% or less). One or more of the nucleotide sequences are non-exonic in some embodiments, and sometimes one or more of the nucleotide sequences are intergenic, intronic, partially exonic or partially non-exonic. In certain embodiments, a nucleotide sequence in a set comprises an exonic nucleotide sequence, intergenic sequence or a non-exonic nucleotide sequence. In some embodiments, one or more nucleotide sequence species are selected from the group consisting of those listed in Table 4B herein. In certain embodiments, the entire length of a nucleotide sequence species provided in Table 4B is amplified, and in some embodiments a nucleic acid is amplified that is shorter or longer than a nucleotide sequence species provided in Table 4B. In certain embodiments, the entire length of a nucleotide sequence species provided in Table 4B is detected, and in some embodiments a nucleic acid is detected that is shorter or longer than a nucleotide sequence species provided in Table 4B.

In some embodiments, one or more synthetic competitor templates that contain a mismatch are introduced at a known concentration, whereby the competitor can facilitate determining the amount of each amplified nucleic acid species in each set. The synthetic competitor template should amplify at a substantially reproducible level relative to each other nucleotide sequence in a set.

One or more of the sets comprises two nucleotide sequences in some embodiments, and sometimes one or more sets comprise three nucleotide sequences. In some embodiments, in about 50%, 60%, 70%, 80%, 90% or 100% of sets, two nucleotide sequences are in a set, and sometimes in about 50%, 60%, 70%, 80%, 90% or 100% of sets, three nucleotide sequences are in a set. In a set, nucleotide sequence species sometimes are on chromosome 21 and chromosome 18, or are on chromosome 21 and chromosome 13, or are on chromosome 13 and chromosome 18, or are on chromosome 21, and chromosome 18 and chromosome 13, and in about 50%, 60%, 70%, 80%, 90% or 100% of sets, the nucleotide species are on such designated chromosomes. In certain embodiments, each nucleotide sequence in all sets is present on chromosome 21, chromosome 18 and chromosome 13.

In some embodiments, the amplification species of the sets are generated in one reaction vessel. The amplified nucleic acid species in a set sometimes are prepared by a process that comprises contacting the extracellular nucleic acid with one reverse primer and one forward primer, and in some embodiments, nucleotide sequences in a set are amplified using two or more primer pairs. In certain embodiments, the amounts of the amplified nucleic acid species in each set vary by about 50%, 40%, 30%, 20%, 10% or less, and in some embodiments, the amounts of the amplified nucleic acid species in each set vary by up to a value that permits detection of the chromosome abnormality with a confidence level of about 95% or more. The length of each of the amplified nucleic acid species independently is about 30 to about 500 base pairs (e.g., about 50, 55, 60, 65, 70, 75, 80, 85, 90, 95 or 100 base pairs in length) in some embodiments.

The amount of amplified nucleic acid species means the absolute copy number of a nucleic acid species or the relative quantities of nucleic acid species compared to each other or some standard. The amount of each amplified nucleic acid species, in certain embodiments, is determined by any detection method known, including, without limitation, primer extension, sequencing, digital polymerase chain reaction (dPCR), quantitative PCR (Q-PCR) and mass spectrometry. In some embodiments, the amplified nucleic acid species are detected by: (i) contacting the amplified nucleic acid species with extension primers, (ii) preparing extended extension primers, and (iii) determining the relative amount of the one or more mismatch nucleotides by analyzing the extended extension primers. The one or more mismatch nucleotides are analyzed by mass spectrometry in some embodiments.

For multiplex methods described herein, there are about 4 to about 100 sets of nucleotide sequences, or amplification nucleic acids, in certain embodiments (e.g., about 8, 9, 10, 11, 12, 13, 14, 15, 16, 17, 18, 19, 20, 21, 22, 23, 24 or 25 sets). In some embodiments, a plurality of specific sets is in a group, and an aneuploidy determination method comprises assessing the same group multiple times (e.g., two or more times; 2, 3, 4, 5, 6, 7, 8, 9 or 10 or more times). For example, a group may include sets A, B and C, and this same group of sets can be assessed multiple times (e.g., three times).

In certain embodiments, an aneuploidy determination method comprises assessing different groups, where each group has different sets of nucleotide sequences. In some embodiments, one or more sets may overlap, or not overlap, between one or more groups. For example, one group including sets A, B and C and a second group including sets D, E and F can be assessed, where each group is assessed one time or multiple times, for an aneuploidy determination.

In certain embodiments, a nucleotide sequence species designated by an asterisk in Table 4 herein, and/or an associated amplification primer nucleic acid or extension nucleic acid, is not included in a method or composition described herein. In some embodiments, nucleotide sequence species in a set of nucleic acids are not from chromosome 13 or chromosome 18.

In some embodiments, the presence or absence of the chromosome abnormality is based on the amounts of the nucleic acid species in 80% or more of the sets. The number of sets provides a 70% to 99.99%, and sometimes 85% to 99.99%, sensitivity for determining the absence of the chromosome abnormality in some embodiments (e.g., about 82, 84, 86, 88, 90, 91, 92, 93, 94, 95, 96, 97, 98, 99 or 99.5% sensitivity), and in certain embodiments, the number of sets provides a 70% to 99.99%, and sometimes 85% to 99.99%, specificity for determining the presence of the chromosome abnormality (e.g., about 82, 84, 86, 88, 90, 91, 92, 93, 94, 95, 96, 97, 98, 99 or 99.5% specificity). In certain embodiments, the number of sets is determined based on (i) a 80% to 99.99% sensitivity for determining the absence of the chromosome abnormality, and (ii) a 80% to 99.99% specificity for determining the presence of the chromosome abnormality. In higher risk pregnancies (e.g., those assessed as such by a health care provider or those of females over 35 or 40 years of age), it can be assumed there will be a higher frequency of the presence of a chromosome abnormality, and select (i) number of sets, and/or (ii) types of nucleotide sequences that provide a (a) relatively lower specificity and (b) relatively higher sensitivity, in some embodiments. In certain embodiments, a method herein comprises determining a ratio between the relative amount of (i) an amplified nucleic acid species and (ii) another amplified nucleic acid species, in each set; and determining the presence or absence of the chromosome abnormality is identified by the ratio. In some embodiments, the presence or absence of the chromosome abnormality is based on nine or fewer replicates (e.g., about 8, 7, 6, 5, 4, 3 or 2 replicates) or on no replicates, but just a single result from a sample. In a related embodiment, the amplification reaction is done in nine or fewer replicates (e.g., about 8, 7, 6, 5, 4, 3 or 2 replicates).

Also provided herein are kits for identifying presence or absence of chromosome abnormality. In certain embodiments, the kits comprise one or more of (i) one or more amplification primers for amplifying a nucleotide sequence species of a set, (ii) one or more extension primers for discriminating between amplified nucleic acid species or nucleotide sequence species of each set, (iii) a solid support for multiplex detection of amplified nucleic acid species or nucleotide sequence species of each set (e.g., a solid support that includes matrix for matrix-assisted laser desorption ionization (MALDI) mass spectrometry; (iv) reagents for detecting amplified nucleic acid species or nucleotide sequence species of each set; (vi) a detector for detecting the amplified nucleic acid species or nucleotide sequence species of each set (e.g., mass spectrometer); (vii) reagents and/or equipment for quantifying fetal nucleic acid in extracellular nucleic acid from a pregnant female; (viii) reagents and/or equipment for enriching fetal nucleic acid from extracellular nucleic acid from a pregnant female; (ix) software and/or a machine for analyzing signals resulting from a process for detecting the amplified nucleic acid species or nucleotide sequence species of the sets; (x) information for identifying presence or absence of a chromosome abnormality (e.g., tables that convert signal information or ratios into outcomes), (xi) container and/or reagents for procuring extracellular nucleic acid (e.g., equipment for drawing blood; equipment for generating cell-free blood; reagents for isolating nucleic acid (e.g., DNA) from plasma or serum; reagents for stabilizing serum or plasma or nucleic acid for shipment and/or processing).

Certain embodiments are described further in the following description, claims and drawings.

BRIEF DESCRIPTION OF THE DRAWINGS

FIG. 1 provides an overview for using paralogs to detect chromosomal imbalances from a sample comprising a hetergenous mixture of extracellular nucleic acid. FIG. 1 discloses SEQ ID NOS 5178-5179, respectively, in order of appearance.

FIG. 7 shows an example of a working assay and a poor assay based on DNA set 2. For the working assay, the observed results (darker crosses and corresponding light-colored line) show a linear response that match the expected results (lighter crosses and corresponding dark-colored line); whereas, the poor assay does not show a linear response and does not match the expected results.

DETAILED DESCRIPTION

Figure 2:
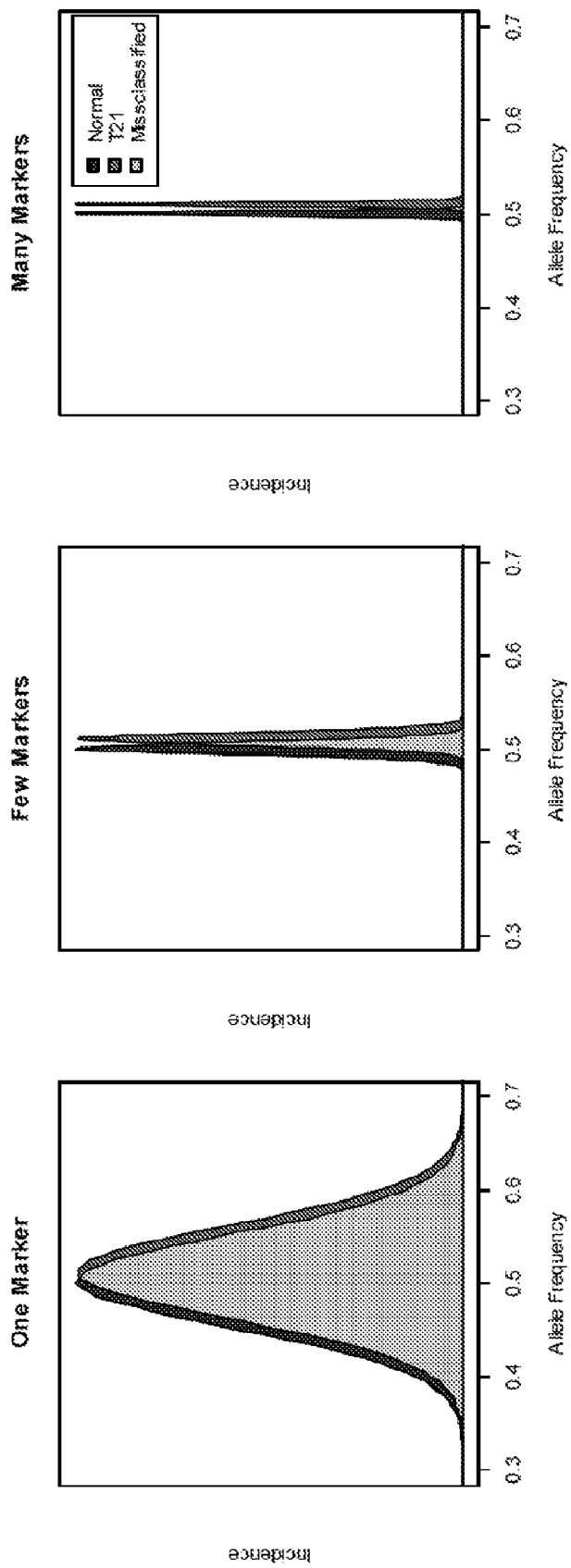
FIG. 2 shows more marker sets (e.g., multiplexed assays) increases discernibility between euploids and aneuploids.

Provided herein are improved processes and kits for identifying presence or absence of a chromosome abnormality. Such processes and kits impart advantages of (i) decreasing risk of pregnancy complications as they are non-invasive; (ii) providing rapid results; and (iii) providing results with a high degree of one or more of confidence, specificity and sensitivity, for example. Processes and kits described herein can be applied to identifying presence or absence of a variety of chromosome abnormalities, such as trisomy 21, trisomy 18 and/or trisomy 13, and aneuploid states associated with particular cancers, for example. Further, such processes and kits are useful for applications including, but not limited to, non-invasive prenatal screening and diagnostics, cancer detection, copy number variation detection, and as quality control tools for molecular biology methods relating to cellular replication (e.g., stem cells).

Chromosome Abnormalities

Chromosome abnormalities include, without limitation, a gain or loss of an entire chromosome or a region of a chromosome comprising one or more genes. Chromosome abnormalities include monosomies, trisomies, polysomies, loss of heterozygosity, deletions and/or duplications of one or more nucleotide sequences (e.g., one or more genes), including deletions and duplications caused by unbalanced translocations. The terms "aneuploidy" and "aneuploid" as used herein refer to an abnormal number of chromosomes in cells of an organism. As different organisms have widely varying chromosome complements, the term "aneuploidy" does not refer to a particular number of chromosomes, but rather to the situation in which the chromosome content within a given cell or cells of an organism is abnormal.

The term "monosomy" as used herein refers to lack of one chromosome of the normal complement. Partial monosomy can occur in unbalanced translocations or deletions, in which only a portion of the chromosome is present in a single copy (see deletion (genetics)). Monosomy of sex chromosomes (45, X) causes Turner syndrome.

The term "disomy" refers to the presence of two copies of a chromosome. For organisms such as humans that have two copies of each chromosome (those that are diploid or "euploid"), it is the normal condition. For organisms that normally have three or more copies of each chromosome (those that are triploid or above), disomy is an aneuploid chromosome complement. In uniparental disomy, both copies of a chromosome come from the same parent (with no contribution from the other parent).

The term "trisomy" refers to the presence of three copies, instead of the normal two, of a particular chromosome. The presence of an extra chromosome 21, which is found in Down syndrome, is called trisomy 21. Trisomy 18 and Trisomy 13 are the two other autosomal trisomies recognized in live-born humans. Trisomy of sex chromosomes can be seen in females (47, XXX) or males (47, XXY which is found in Klinefelter's syndrome; or 47, XYY).

The terms "tetrasomy" and "pentasomy" as used herein refer to the presence of four or five copies of a chromosome, respectively. Although rarely seen with autosomes, sex chromosome tetrasomy and pentasomy have been reported in humans, including XXXX, XXXY, XXYY, XYYY, XXXXX, XXXXY, XXXYY, XXYYY and XYYYY.

Chromosome abnormalities can be caused by a variety of mechanisms. Mechanisms include, but are not limited to (i) nondisjunction occurring as the result of a weakened mitotic checkpoint, (ii) inactive mitotic checkpoints causing nondisjunction at multiple chromosomes, (iii) merotelic attachment occurring when one kinetochore is attached to both mitotic spindle poles, (iv) a multipolar spindle forming when more than two spindle poles form, (v) a monopolar spindle forming when only a single spindle pole forms, and (vi) a tetraploid intermediate occurring as an end result of the monopolar spindle mechanism.

The terms "partial monosomy" and "partial trisomy" as used herein refer to an imbalance of genetic material caused by loss or gain of part of a chromosome. A partial monosomy or partial trisomy can result from an unbalanced translocation, where an individual carries a derivative chromosome formed through the breakage and fusion of two different chromosomes. In this situation, the individual would have three copies of part of one chromosome (two normal copies and the portion that exists on the derivative chromosome) and only one copy of part of the other chromosome involved in the derivative chromosome.

The term "mosaicism" as used herein refers to aneuploidy in some cells, but not all cells, of an organism. Certain chromosome abnormalities can exist as mosaic and non-mosaic chromosome abnormalities. For example, certain trisomy 21 individuals have mosaic Down syndrome and some have non-mosaic Down syndrome. Different mechanisms can lead to mosaicism. For example, (i) an initial zygote may have three 21st chromosomes, which normally would result in simple trisomy 21, but during the course of cell division one or more cell lines lost one of the 21st chromosomes; and (ii) an initial zygote may have two 21st chromosomes, but during the course of cell division one of the 21st chromosomes were duplicated. Somatic mosaicism most likely occurs through mechanisms distinct from those typically associated with genetic syndromes involving complete or mosaic aneuploidy. Somatic mosaicism has been identified in certain types of cancers and in neurons, for example. In certain instances, trisomy 12 has been identified in chronic lymphocytic leukemia (CLL) and trisomy 8 has been identified in acute myeloid leukemia (AML). Also, genetic syndromes in which an individual is predisposed to breakage of chromosomes (chromosome instability syndromes) are frequently associated with increased risk for various types of cancer, thus highlighting the role of somatic aneuploidy in carcinogenesis. Methods and kits described herein can identify presence or absence of non-mosaic and mosaic chromosome abnormalities.

Following is a non-limiting list of chromosome abnormalities that can be potentially identified by methods and kits described herein.

| Chromosome Abnormality | | Disease Association |
| --- | --- | --- |
| X | XO | Turner's Syndrome |
| Y | XXY | Klinefelter syndrome |
| Y | XYY | Double Y syndrome |
| Y | XXX | Trisomy X syndrome |
| Y | XXXX | Four X syndrome |
| Y | Xp21 deletion | Duchenne's/Becker syndrome, congenital adrenal hypoplasia, chronic granulomatus disease |
| Y | Xp22 deletion | steroid sulfatase deficiency |
| Y | Xq26 deletion | X-linked lymphproliferative disease |
| 1 | 1p (somatic) monosomy trisomy | neuroblastoma |
| 2 | monosomy trisomy 2q | growth retardation, developmental and mental delay, and minor physical abnormalities |
| 3 | monosomy trisomy (somatic) | Non-Hodgkin's lymphoma |
| 4 | monosomy trsiomy (somatic) | Acute non lymphocytic leukaemia (ANLL) |

-continued

| Chromosome | Abnormality | Disease Association |
|---|---|---|
| 5 | 5p | Cri du chat; Lejeune syndrome |
| 5 | 5q | myelodysplastic syndrome |
| 5 | (somatic) monosomy trisomy | |
| 6 | monosmy trisomy (somatic) | clear-cell sarcoma |
| 7 | 7q11.23 deletion | William's syndrome |
| 7 | monosomy trisomy | monosomy 7 syndrome of childhood; somatic: renal cortical adenomas; myelodysplastic syndrome |
| 8 | 8q24.1 deletion | Langer-Giedon syndrome |
| 8 | monosomy trisomy | myelodysplastic syndrome; Warkany syndrome; somatic: chronic myelogenous leukemia |
| 9 | monosomy 9p | Alfi's syndrome |
| 9 | monosomy 9p partial trisomy | Rethore syndrome |
| 9 | trisomy | complete trisomy 9 syndrome; mosaic trisomy 9 syndrome |
| 10 | Monosomy trisomy (somatic) | ALL or ANLL |
| 11 | 11p- | Aniridia; Wilms tumor |
| 11 | 11q- | Jacobson Syndrome |
| 11 | monosomy (somatic) trisomy | myeloid lineages affected (ANLL, MDS) |
| 12 | monosomy trisomy (somatic) | CLL, Juvenile granulosa cell tumor (JGCT) |
| 13 | 13q- | 13q-syndrome; Orbeli syndrome |
| 13 | 13q14 deletion | retinoblastoma |
| 13 | monosomy trisomy | Patau's syndrome |
| 14 | monsomy trisomy (somatic) | myeloid disorders (MDS, ANLL, atypical CML) |
| 15 | 15q11-q13 deletion monosomy | Prader-Willi, Angelman's syndrome |
| 15 | trisomy (somatic) | myeloid and lymphoid lineages affected, e.g., MDS, ANLL, ALL, CLL) |
| 16 | 16q13.3 deletion | Rubenstein-Taybi |
| | monosomy trisomy (somatic) | papillary renal cell carcinomas (malignant) |
| 17 | 17p-(somatic) | 17p syndrome in myeloid malignancies |
| 17 | 17q11.2 deletion | Smith-Magenis |
| 17 | 17q13.3 | Miller-Dieker |
| 17 | monosomy trisomy (somatic) | renal cortical adenomas |
| 17 | 17p11.2-12 trisomy | Charcot-Marie Tooth Syndrome type 1; HNPP |
| 18 | 18p- | 18p partial monosomy syndrome or Grouchy Lamy Thieffry syndrome |
| 18 | 18q- | Grouchy Lamy Salmon Landry Syndrome |
| 18 | monosomy trisomy | Edwards Syndrome |
| 19 | monosomy trisomy | |
| 20 | 20p- | trisomy 20p syndrome |
| 20 | 20p11.2-12 deletion | Alagille |
| 20 | 20q- | somatic: MDS, ANLL, polycythemia vera, chronic neutrophilic leukemia |
| 20 | monosomy trisomy (somatic) | papillary renal cell carcinomas (malignant) |
| 21 | monosomy trisomy | Down's syndrome |
| 22 | 22q11.2 deletion | DiGeorge's syndrome, velocardiofacial syndrome, conotruncal anomaly face syndrome, autosomal dominant Opitz G/BBB syndrome, Caylor cardiofacial syndrome |
| 22 | monosomy trisomy | complete trisomy 22 syndrome |

In certain embodiments, presence or absence of a fetal chromosome abnormality is identified (e.g., trisomy 21, trisomy 18 and/or trisomy 13). In some embodiments, presence or absence of a chromosome abnormality related to a cell proliferation condition or cancer is identified. Presence or absence of one or more of the chromosome abnormalities described in the table above may be identified in some embodiments.

Template Nucleic Acid

Template nucleic acid utilized in methods and kits described herein often is obtained and isolated from a subject. A subject can be any living or non-living source, including but not limited to a human, an animal, a plant, a bacterium, a fungus, a protist. Any human or animal can be selected, including but not limited, non-human, mammal, reptile, cattle, cat, dog, goat, swine, pig, monkey, ape, gorilla, bull, cow, bear, horse, sheep, poultry, mouse, rat, fish, dolphin, whale, and shark, or any animal or organism that may have a detectable chromosome abnormality.

Template nucleic acid may be isolated from any type of fluid or tissue from a subject, including, without limitation, umbilical cord blood, chorionic villi, amniotic fluid, cerbrospinal fluid, spinal fluid, lavage fluid (e.g., bronchoalveolar, gastric, peritoneal, ductal, ear, athroscopic), biopsy sample (e.g., from pre-implantation embryo), celocentesis sample, fetal nucleated cells or fetal cellular remnants, washings of female reproductive tract, urine, feces, sputum, saliva, nasal mucous, prostate fluid, lavage, semen, lymphatic fluid, bile, tears, sweat, breast milk, breast fluid, embryonic cells and fetal cells. In some embodiments, a biological sample may be blood, and sometimes plasma. As used herein, the term "blood" encompasses whole blood or any fractions of blood, such as serum and plasma as conventionally defined. Blood plasma refers to the fraction of whole blood resulting from centrifugation of blood treated with anticoagulants. Blood serum refers to the watery portion of fluid remaining after a blood sample has coagulated. Fluid or tissue samples often are collected in accordance with standard protocols hospitals or clinics generally follow. For blood, an appropriate amount of peripheral blood (e.g., between 3-40 milliliters) often is collected and can be stored according to standard procedures prior to further preparation in such embodiments. A fluid or tissue sample from which template nucleic acid is extracted may be acellular. In some embodiments, a fluid or tissue sample may contain cellular elements or cellular remnants. In some embodiments fetal cells or cancer cells may comprise the sample.

The sample may be heterogeneous, by which is meant that more than one type of nucleic acid species is present in the sample. For example, heterogeneous nucleic acid can include, but is not limited to, (i) fetally derived and maternally derived nucleic acid, (ii) cancer and non-cancer nucleic acid, and (iii) more generally, mutated and wild-type nucleic acid. A sample may be heterogeneous because more than one cell type is present, such as a fetal cell and a maternal cell or a cancer and non-cancer cell.

For prenatal applications of technology described herein, fluid or tissue sample may be collected from a female at a gestational age suitable for testing, or from a female who is being tested for possible pregnancy. Suitable gestational age may vary depending on the chromosome abnormality tested. In certain embodiments, a pregnant female subject sometimes is in the first trimester of pregnancy, at times in the second trimester of pregnancy, or sometimes in the third trimester of pregnancy. In certain embodiments, a fluid or tissue is collected from a pregnant woman at 1-4, 4-8, 8-12, 12-16, 16-20, 20-24, 24-28, 28-32, 32-36, 36-40, or 40-44 weeks of fetal gestation, and sometimes between 5-28 weeks of fetal gestation.

Template nucleic acid can be extracellular nucleic acid in certain embodiments. The term "extracellular template nucleic acid" as used herein refers to nucleic acid isolated from a source having substantially no cells (e.g., no detectable cells; may contain cellular elements or cellular remnants). Examples of acellular sources for extracellular nucleic acid are blood plasma, blood serum and urine. Without being limited by theory, extracellular nucleic acid may be a product of cell apoptosis and cell breakdown, which provides basis for extracellular nucleic acid often having a series of lengths across a large spectrum (e.g., a "ladder").

Extracellular template nucleic acid can include different nucleic acid species, and therefore is referred to herein as "heterogeneous" in certain embodiments. For example, blood serum or plasma from a person having cancer can include nucleic acid from cancer cells and nucleic acid from non-cancer cells. In another example, blood serum or plasma from a pregnant female can include maternal nucleic acid and fetal nucleic acid. In some instances, fetal nucleic acid sometimes is about 5% to about 40% of the overall template nucleic acid (e.g., about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or 39% of the template nucleic acid is fetal nucleic acid). In some embodiments, the majority of fetal nucleic acid in template nucleic acid is of a length of about 500 base pairs or less (e.g., about 80, 85, 90, 91, 92, 93, 94, 95, 96, 97, 98, 99 or 100% of fetal nucleic acid is of a length of about 500 base pairs or less).

The terms "nucleic acid" and "nucleic acid molecule" may be used interchangeably throughout the disclosure. The terms refer to nucleic acids of any composition from, such as deoxyribonucleic acid (DNA, e.g., complementary DNA (cDNA), genomic DNA (gDNA) and the like), ribonucleic acid (RNA, e.g., message RNA (mRNA), short inhibitory RNA (siRNA), ribosomal RNA (rRNA), transfer RNA (tRNA), microRNA, RNA highly expressed by the fetus or placenta, and the like), and/or DNA or RNA analogs (e.g., containing base analogs, sugar analogs and/or a non-native backbone and the like), RNA/DNA hybrids and polyamide nucleic acids (PNAs), all of which can be in single- or double-stranded form, and unless otherwise limited, can encompass known analogs of natural nucleotides that can function in a similar manner as naturally occurring nucleotides. A nucleic acid can be in any form useful for conducting processes herein (e.g., linear, circular, supercoiled, single-stranded, double-stranded and the like). A nucleic acid may be, or may be from, a plasmid, phage, autonomously replicating sequence (ARS), centromere, artificial chromosome, chromosome, or other nucleic acid able to replicate or be replicated in vitro or in a host cell, a cell, a cell nucleus or cytoplasm of a cell in certain embodiments. A template nucleic acid in some embodiments can be from a single chromosome (e.g., a nucleic acid sample may be from one chromosome of a sample obtained from a diploid organism). The term also may include, as equivalents, derivatives, variants and analogs of RNA or DNA synthesized from nucleotide analogs, single-stranded ("sense" or "antisense", "plus" strand or "minus" strand, "forward" reading frame or "reverse" reading frame) and double-stranded polynucleotides. Deoxyribonucleotides include deoxyadenosine, deoxycytidine, deoxyguanosine and deoxythymidine. For RNA, the base cytosine is replaced with uracil. A template nucleic acid may be prepared using a nucleic acid obtained from a subject as a template.

Template nucleic acid may be derived from one or more sources (e.g., cells, soil, etc.) by methods known to the person of ordinary skill in the art. Cell lysis procedures and reagents are commonly known in the art and may generally be performed by chemical, physical, or electrolytic lysis methods. For example, chemical methods generally employ lysing agents to disrupt the cells and extract the nucleic acids from the cells, followed by treatment with chaotropic salts. Physical methods such as freeze/thaw followed by grinding, the use of cell presses and the like are also useful. High salt lysis procedures are also commonly used. For example, an alkaline lysis procedure may be utilized. The latter procedure traditionally incorporates the use of phenol-chloroform solutions, and an alternative phenol-chloroform-free procedure involving three solutions can be utilized. In the latter procedures, solution 1 can contain 15 mM Tris, pH 8.0; 10 mM EDTA and 100 ug/ml Rnase A; solution 2 can contain 0.2N NaOH and 1% SDS; and solution 3 can contain 3M KOAc, pH 5.5. These procedures can be found in Current Protocols in Molecular Biology, John Wiley & Sons, N.Y., 6.3.1-6.3.6 (1989), incorporated herein in its entirety.

Template nucleic acid also may be isolated at a different time point as compared to another template nucleic acid, where each of the samples are from the same or a different source. A template nucleic acid may be from a nucleic acid library, such as a cDNA or RNA library, for example. A template nucleic acid may be a result of nucleic acid purification or isolation and/or amplification of nucleic acid molecules from the sample. Template nucleic acid provided for processes described herein may contain nucleic acid from one sample or from two or more samples (e.g., from 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, or 20 or more samples).

Template nucleic acid may be provided for conducting methods described herein without processing of the sample(s) containing the nucleic acid in certain embodiments. In some embodiments, template nucleic acid is provided for conducting methods described herein after processing of the sample(s) containing the nucleic acid. For example, a template nucleic acid may be extracted, isolated, purified or amplified from the sample(s). The term "isolated" as used herein refers to nucleic acid removed from its original environment (e.g., the natural environment if it is naturally occurring, or a host cell if expressed exogenously), and thus is altered by human intervention (e.g., "by the hand of man") from its original environment. An isolated nucleic acid generally is provided with fewer non-nucleic acid components (e.g., protein, lipid) than the amount of components present in a source sample. A composition comprising isolated template nucleic acid can be substantially isolated (e.g., about 90%, 91%, 92%, 93%, 94%, 95%, 96%, 97%, 98%, 99% or greater than 99% free of non-nucleic acid components). The term "purified" as used herein refers to template nucleic acid provided that contains fewer nucleic acid species than in the sample source from which the template nucleic acid is derived. A composition comprising template nucleic acid may be substantially purified (e.g., about 90%, 91%, 92%, 93%, 94%, 95%, 96%, 97%, 98%, 99% or greater than 99% free of other nucleic acid species). The term "amplified" as used herein refers to subjecting nucleic acid of a sample to a process that linearly or exponentially generates amplicon nucleic acids having the same or substantially the same nucleotide sequence as the nucleotide sequence of the nucleic acid in the sample, or portion thereof.

Template nucleic acid also may be processed by subjecting nucleic acid to a method that generates nucleic acid fragments, in certain embodiments, before providing template nucleic acid for a process described herein. In some embodiments, template nucleic acid subjected to fragmentation or cleavage may have a nominal, average or mean length of about 5 to about 10,000 base pairs, about 100 to about 1,000 base pairs, about 100 to about 500 base pairs, or about 10, 15, 20, 25, 30, 35, 40, 45, 50, 55, 60, 65, 70, 75, 80, 85, 90, 95, 100, 200, 300, 400, 500, 600, 700, 800, 900, 1000, 2000, 3000, 4000, 5000, 6000, 7000, 8000 or 9000 base pairs. Fragments can be generated by any suitable method known in the art, and the average, mean or nominal length of nucleic acid fragments can be controlled by selecting an appropriate fragment-generating procedure by the person of ordinary skill. In certain embodiments, template nucleic acid of a relatively shorter length can be utilized to analyze sequences that contain little sequence variation and/or contain relatively large amounts of known nucleotide sequence information. In some embodiments, template nucleic acid of a relatively longer length can be utilized to analyze sequences that contain greater sequence variation and/or contain relatively small amounts of unknown nucleotide sequence information.

Template nucleic acid fragments may contain overlapping nucleotide sequences, and such overlapping sequences can facilitate construction of a nucleotide sequence of the previously non-fragmented template nucleic acid, or a portion thereof. For example, one fragment may have subsequences x and y and another fragment may have subsequences y and z, where x, y and z are nucleotide sequences that can be 5 nucleotides in length or greater. Overlap sequence y can be utilized to facilitate construction of the x-y-z nucleotide sequence in nucleic acid from a sample in certain embodiments. Template nucleic acid may be partially fragmented (e.g., from an incomplete or terminated specific cleavage reaction) or fully fragmented in certain embodiments.

Template nucleic acid can be fragmented by various methods known to the person of ordinary skill, which include without limitation, physical, chemical and enzymatic processes. Examples of such processes are described in U.S. Patent Application Publication No. 20050112590 (published on May 26, 2005, entitled "Fragmentation-based methods and systems for sequence variation detection and discovery," naming Van Den Boom et al.). Certain processes can be selected by the person of ordinary skill to generate non-specifically cleaved fragments or specifically cleaved fragments. Examples of processes that can generate non-specifically cleaved fragment template nucleic acid include, without limitation, contacting template nucleic acid with apparatus that expose nucleic acid to shearing force (e.g., passing nucleic acid through a syringe needle; use of a French press); exposing template nucleic acid to irradiation (e.g., gamma, x-ray, UV irradiation; fragment sizes can be controlled by irradiation intensity); boiling nucleic acid in water (e.g., yields about 500 base pair fragments) and exposing nucleic acid to an acid and base hydrolysis process.

Template nucleic acid may be specifically cleaved by contacting the nucleic acid with one or more specific cleavage agents. The term "specific cleavage agent" as used herein refers to an agent, sometimes a chemical or an enzyme that can cleave a nucleic acid at one or more specific sites. Specific cleavage agents often cleave specifically according to a particular nucleotide sequence at a particular site.

Examples of enzymatic specific cleavage agents include without limitation endonucleases (e.g., DNase (e.g., DNase I, II); RNase (e.g., RNase E, F, H, P); Cleavase™ enzyme; Taq DNA polymerase; *E. coli* DNA polymerase I and eukaryotic structure-specific endonucleases; murine FEN-1 endonucleases; type I, II or III restriction endonucleases such as Acc I, Afl III, Alu I, Alw44 I, Apa I, Asn I, Ava I, Ava II, BamH I, Ban II, Bcl I, Bgl I. Bgl II, Bln I, Bsm I, BssH II, BstE II, Cfo I, Cla I, Dde I, Dpn I, Dra I, EcIX I, EcoR I, EcoR I, EcoR II, EcoR V, Hae II, Hae II, Hind II, Hind III, Hpa I, Hpa II, Kpn I, Ksp I, Mlu I, MluN I, Msp I, Nci I, Nco I, Nde I, Nde II, Nhe I, Not I, Nru I, Nsi I, Pst I, Pvu I, Pvu II, Rsa I, Sac I, Sal I, Sau3A I, Sca I, ScrF I, Sfi I, Sma I, Spe I, Sph I, Ssp I, Stu I, Sty I, Swa I, Taq I, Xba I, Xho I.); glycosylases (e.g., uracil-DNA glycolsylase (UDG), 3-methyladenine DNA glycosylase, 3-methyladenine DNA glycosylase II, pyrimidine hydrate-DNA glycosylase, FaPy-DNA glycosylase, thymine mismatch-DNA glycosylase, hypoxanthine-DNA glycosylase, 5-Hydroxymethyluracil DNA glycosylase (HmUDG), 5-Hydroxymethylcytosine DNA glycosylase, or 1,N6-etheno-adenine DNA glycosylase); exonucleases (e.g., exonuclease III); ribozymes, and DNA-zymes. Template nucleic acid may be treated with a chemical agent, and the modified nucleic acid may be cleaved. In non-limiting examples, template nucleic acid may be treated with (i) alkylating agents such as methylnitrosourea that generate several alkylated bases, including N3-methyladenine and N3-methylguanine, which are recognized and cleaved by alkyl purine DNA-glycosylase; (ii) sodium bisulfite, which causes deamination of cytosine residues in DNA to form uracil residues that can be cleaved by uracil N-glycosylase; and (iii) a chemical agent that converts guanine to its oxidized form, 8-hydroxyguanine, which can be cleaved by formamidopyrimidine DNA N-glycosylase. Examples of chemical cleavage processes include without limitation alkylation, (e.g., alkylation of phosphorothioate-modified nucleic acid); cleavage of acid lability of P3'-N5'-phosphoroamidate-containing nucleic acid; and osmium tetroxide and piperidine treatment of nucleic acid.

As used herein, "fragmentation" or "cleavage" refers to a procedure or conditions in which a nucleic acid molecule, such as a nucleic acid template gene molecule or amplified product thereof, may be severed into two or more smaller nucleic acid molecules. Such fragmentation or cleavage can be sequence specific, base specific, or nonspecific, and can be accomplished by any of a variety of methods, reagents or conditions, including, for example, chemical, enzymatic, physical fragmentation.

As used herein, "fragments", "cleavage products", "cleaved products" or grammatical variants thereof, refers to nucleic acid molecules resultant from a fragmentation or cleavage of a nucleic acid template gene molecule or amplified product thereof. While such fragments or cleaved products can refer to all nucleic acid molecules resultant from a cleavage reaction, typically such fragments or cleaved products refer only to nucleic acid molecules resultant from a fragmentation or cleavage of a nucleic acid template gene molecule or the portion of an amplified product thereof containing the corresponding nucleotide sequence of a nucleic acid template gene molecule. For example, it is within the scope of the present methods, compounds and compositions, that an amplified product can contain one or more nucleotides more than the amplified nucleotide region of the nucleic acid template gene sequence (e.g., a primer can contain "extra" nucleotides such as a transcriptional initiation sequence, in addition to nucleotides complementary to a nucleic acid template gene molecule, resulting in an amplified product containing "extra" nucleotides or nucleotides not corresponding to the amplified nucleotide region of the nucleic acid template gene molecule). In such an example, the fragments or cleaved products corresponding to the nucleotides not arising from the nucleic acid template molecule will typically not provide any information regarding methylation in the nucleic acid template molecule. One skilled in the art can therefore understand that the fragments of an amplified product used to provide methylation information in the methods provided herein may be fragments containing one or more nucleotides arising from the nucleic acid template molecule, and not fragments containing nucleotides arising solely from a sequence other than that in the nucleic acid target molecule. Accordingly, one skilled in the art will understand the fragments arising from methods, compounds and compositions provided herein to include fragments arising from portions of amplified nucleic acid molecules containing, at least in part, nucleotide sequence information from or based on the representative nucleic acid template molecule.

As used herein, the term "complementary cleavage reactions" refers to cleavage reactions that are carried out on the same template nucleic acid using different cleavage reagents or by altering the cleavage specificity of the same cleavage reagent such that alternate cleavage patterns of the same target or reference nucleic acid or protein are generated. In certain embodiments, template nucleic acid may be treated with one or more specific cleavage agents (e.g., 1, 2, 3, 4, 5, 6, 7, 8, 9, 10 or more specific cleavage agents) in one or more reaction vessels (e.g., template nucleic acid is treated with each specific cleavage agent in a separate vessel).

Template nucleic acid also may be exposed to a process that modifies certain nucleotides in the nucleic acid before providing template nucleic acid for a method described herein. A process that selectively modifies nucleic acid based upon the methylation state of nucleotides therein can be applied to template nucleic acid, for example. The term "methylation state" as used herein refers to whether a particular nucleotide in a polynucleotide sequence is methylated or not methylated. Methods for modifying a template nucleic acid molecule in a manner that reflects the methylation pattern of the template nucleic acid molecule are known in the art, as exemplified in U.S. Pat. No. 5,786,146 and U.S. patent publications 20030180779 and 20030082600. For example, non-methylated cytosine nucleotides in a nucleic acid can be converted to uracil by bisulfite treatment, which does not modify methylated cytosine. Non-limiting examples of agents that can modify a nucleotide sequence of a nucleic acid include methylmethane sulfonate, ethylmethane sulfonate, diethylsulfate, nitrosoguanidine (N-methyl-N'-nitro-N-nitrosoguanidine), nitrous acid, di-(2-chloroethyl)sulfide, di-(2-chloroethyl) methylamine, 2-aminopurine, t-bromouracil, hydroxylamine, sodium bisulfite, hydrazine, formic acid, sodium nitrite, and 5-methylcytosine DNA glycosylase. In addition, conditions such as high temperature, ultraviolet radiation, x-radiation, can induce changes in the sequence of a nucleic acid molecule. Template nucleic acid may be provided in any form useful for conducting a sequence analysis or manufacture process described herein, such as solid or liquid form, for example. In certain embodiments, template nucleic acid may be provided in a liquid form optionally comprising one or more other components, including without limitation one or more buffers or salts selected by the person of ordinary skill.

Determination of Fetal Nucleic Acid Content and Fetal Nucleic Acid Enrichment

The amount of fetal nucleic acid (e.g., concentration) in template nucleic acid is determined in some embodiments. In certain embodiments, the amount of fetal nucleic acid is determined according to markers specific to a male fetus (e.g., Y-chromosome STR markers (e.g., DYS 19, DYS 385, DYS 392 markers); RhD marker in RhD-negative females), or according to one or more markers specific to fetal nucleic acid and not maternal nucleic acid (e.g., differential methylation between mother and fetus, or fetal RNA markers in maternal blood plasma; Lo, 2005, Journal of Histochemistry and Cytochemistry 53 (3): 293-296). Methylation-based fetal quantifier compositions and processes are described in U.S. application Ser. No. 12/561,241, filed Sep. 16, 2009, which is hereby incorporated by reference. The amount of fetal nucleic acid in extracellular template nucleic acid can be quantified and used in conjunction with the aneuploidy detection methods provided herein. Thus, in certain embodiments, methods of the technology comprise the additional step of determining the amount of fetal nucleic acid. The amount of fetal nucleic acid can be determined in a nucleic acid sample from a subject before or after processing to prepare sample template nucleic acid. In certain embodiments, the amount of fetal nucleic acid is determined in a sample after sample template nucleic acid is processed and prepared, which amount is utilized for further assessment. The determination step can be performed before, during or after aneuploidy detection methods described herein. For example, to achieve an aneuploidy detection method with a given sensitivity or specificity, a fetal nucleic acid quantification method may be implemented prior to, during or after aneuploidy detection to identify those samples with greater than about 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25% or more fetal nucleic acid. In some embodiments, samples determined as having a certain threshold amount of fetal nucleic acid (e.g., about 15% or more fetal nucleic acid) are further analyzed for the presence or absence of aneuploidy. In certain embodiments, determinations of the presence or absence of aneuploidy are selected (e.g., selected and communicated to a patient) only for samples having a certain threshold amount of fetal nucleic acid (e.g., about 15% or more fetal nucleic acid).

In some embodiments, extracellular nucleic acid is enriched or relatively enriched for fetal nucleic acid. Methods for enriching a sample for a particular species of nucleic acid are described in U.S. Pat. No. 6,927,028, filed Aug. 31, 2001, PCT Patent Application Number PCT/US07/69991, filed May 30, 2007, PCT Patent Application Number PCT/US2007/071232, filed Jun. 15, 2007, U.S. Provisional Application Nos. 60/968,876 and 60/968,878, and PCT Patent Application Number PCT/EP05/012707, filed Nov. 28, 2005. In certain embodiments, maternal nucleic acid is selectively removed (partially, substantially, almost completely or completely) from the sample. In certain embodiments, fetal nucleic acid is differentiated and separated from maternal nucleic acid based on methylation differences. Enriching for a particular low copy number species nucleic acid may also improve quantitative sensitivity. For example, the most sensitive peak ratio detection area is within 10% from center point. See FIG. 1.

Nucleotide Sequence Species in a Set

In methods described herein, particular nucleotide sequence species located in a particular target chromosome and in one or more reference chromosomes are analyzed. The term "target chromosome" as used herein is utilized in two contexts, as the term refers to (i) a particular chromosome (e.g., chromosome 21, 18 or 13) and sometimes (ii) a chromosome from a particular target source (e.g., chromosome from a fetus, chromosome from a cancer cell). When the term refers to a particular chromosome, the term "target chromosome" is utilized (e.g., "target chromosome 21") and when the term refers to a particular target chromosome from a particular source, the source of the target chromosome is included (e.g., "fetal target chromosome," "cancer cell target chromosome").

A "set" includes nucleotide sequence species located in a target chromosome and one or more reference chromosomes. Nucleotide sequence species in a set are located in the target chromosome and in the one or more reference chromosomes. The term "reference chromosome" refers to a chromosome that includes a nucleotide sequence species as a subsequence, and sometimes is a chromosome not associated with a particular chromosome abnormality being screened. For example, in a prenatal screening method for Down syndrome (i.e., trisomy 21), chromosome 21 is the target chromosome and another chromosome (e.g., chromosome 5) is the reference chromosome. In certain embodiments, a reference chromosome can be associated with a chromosome abnormality. For example, chromosome 21 can be the target chromosome and chromosome 18 can be the reference chromosome when screening for Down syndrome, and chromosome 18 can the target chromosome and chromosome 21 can be the reference chromosome when screening for Edward syndrome.

The terms "nucleotide sequence species in a set," a "set of nucleotide sequence species" and grammatical variants thereof, as used herein, refer to nucleotide sequence species in a target chromosome and a reference chromosome. Nucleotide sequence species in a set generally share a significant level of sequence identity. One nucleotide sequence species in a set is located in one chromosome and another nucleotide sequence species in a set is located in another chromosome. A nucleotide sequence species in a set located in a target chromosome can be referred to as a "target nucleotide sequence species" and a nucleotide sequence species in a set located in a reference chromosome can be referred to as a "reference nucleotide sequence species."

Nucleotide sequence species in a set share about 50%, 60%, 70%, 80%, 85%, 86%, 87%, 88%, 89%, 90%, 91%, 92%, 93% or 94%, and all intermediate values thereof, identity to one another in some embodiments. Nucleotide sequence species in a set are "substantially identical" to one another to one another in some embodiments, which refers to nucleotide sequence species that share 95%, 96%, 97%, 98% or 99% identity, or greater than 99% identity, with one another, in certain embodiments. For highly identical nucleotide sequence species in a set, the nucleotide sequence species may be identical to one another with the exception of a one base pair mismatch, in certain embodiments. For example, nucleotide sequence species in a set may be identical to one another with the exception of a one base pair mismatch for a nucleotide sequence species length of about 100 base pairs (e.g., about 80, 82, 84, 86, 88, 90, 92, 94, 96, 98, 100, 102, 104, 106, 108, 110, 112, 114, 116, 118 or 120 base pair sequence length). Thus, nucleotide sequence species in a set may be "paralog sequences" or "paralogous sequences," which as used herein refer to nucleotide sequence species that include only one or two base pair mismatches. Paralogous sequences sometimes have a common evolutionary origin and sometimes are duplicated over time in a genome of interest. Paralogous sequences sometimes conserve sequence and gene structure (e.g., number and relative position of introns and exons and often transcript length). In some embodiments, nucleotide sequence species in a set may differ by two or more base pair mismatches (e.g., 2, 3, 4, 5, 6, 7, 8, 9, 10 base pair mismatches), where the mismatched base pairs are sequential or non-sequential (e.g., base pair mismatches may be sequential for about 2, 3, 4, 5, 6, 7, 8, 9 or 10 bases).

Alignment techniques and sequence identity assessment methodology are known. Such analyses can be performed by visual inspection or by using a mathematical algorithm. For example, the algorithm of Meyers & Miller, CABIOS 4: 11-17 (1989), which has been incorporated into the ALIGN program (version 2.0) can be utilized. Utilizing the former algorithm, a PAM120 weight residue table, a gap length penalty of 12 and a gap penalty of 4 may be used for determining sequence identity.

Base pair mismatches between nucleotide sequence species in a set are not significantly polymorphic in certain embodiments, and the nucleotides that give rise to the mismatches are present at a rate of over 95% of subjects and chromosomes in a given population (e.g., the same nucleotides that give rise to the mismatches are present in about 98%, 99% or over 99% of subjects and chromosomes in a population) in some embodiments. Each nucleotide sequence species in a set, in its entirety, often is present in a significant portion of a population without modification (e.g., present without modification in about 97%, 98%, 99%, or over 99% of subjects and chromosomes in a population).

Nucleotide sequence species in a set may be of any convenient length. For example, a nucleotide sequence species in a set can be about 5 to about 10,000 base pairs in length, about 100 to about 1,000 base pairs in length, about 100 to about 500 base pairs in length, or about 10, 15, 20, 25, 30, 35, 40, 45, 50, 55, 60, 65, 70, 75, 80, 85, 90, 95, 100, 200, 300, 400, 500, 600, 700, 800, 900, 1000, 2000, 3000, 4000, 5000, 6000, 7000, 8000 or 9000 base pairs in length. In some embodiments, a nucleotide sequence species in a set is about 100 base pairs in length (e.g., about 80, 82, 84, 86, 88, 90, 92, 94, 96, 98, 100, 102, 104, 106, 108, 110, 112, 114, 116, 118 or 120 base pairs in length). In certain embodiments, nucleotide sequence species in a set are of identical length, and sometimes the nucleotide sequence species in a set are of a different length (e.g., one nucleotide sequence species is longer by about 1 to about 100 nucleotides (e.g., about 2, 3, 4, 5, 6, 7, 8, 9, 10, 11, 12, 13, 14, 15, 16, 17, 18, 19, 20, 30, 40, 50, 60, 70, 80 or 90 nucleotides longer).

Nucleotide sequence species in a set are non-exonic in some embodiments, and sometimes one or more of the nucleotide sequence species in a set are intronic, partially intronic, partially exonic or partially non-exonic. In certain embodiments, a nucleotide sequence in a set comprises an exonic nucleotide sequence.

In some embodiments, one or more nucleotide sequence species are selected from those shown in tables herein (e.g., Table 4A, Table 4B and Table 14).

Each set can include two or more nucleotide sequence species (e.g., 2, 3, 4 or 5 nucleotide sequence species). In some embodiments, the number of target and reference chromosomes equals the number of nucleotide sequence species in a set, and sometimes each of the nucleotide sequence species in a set are present only in one chromosome. In certain embodiments, a nucleotide sequence species is located in more than one chromosome (e.g., 2 or 3 chromosomes).

Methods described herein can be conducted using one set of nucleotide sequence species, and sometimes two or three sets of nucleotide sequence species are utilized. For multiplex methods described herein, about 4 to about 100 sets of nucleotide sequence species can be utilized (e.g., about 8, 9, 10, 11, 12, 13, 14, 15, 16, 17, 18, 19, 20, 21, 22, 23, 24 or 25 sets).

One or more of the sets consist of two nucleotide sequence species in some embodiments, and sometimes one or more sets consist of three nucleotide sequence species. Some embodiments are directed to mixtures of sets in which some sets consist of two nucleotide sequence species and other sets consist of three nucleotide sequence species can be used. In some embodiments, about 50%, 60%, 70%, 80%, 90%, 91%, 92%, 93%, 94%, 95%, 96%, 97%, 98%, 99% or 100% of sets consist of two nucleotide sequence species, and in certain embodiments about 50%, 60%, 70%, 80%, 90%, 91%, 92%, 93%, 94%, 95%, 96%, 97%, 98%, 99% or 100% of sets consist of three nucleotide sequences. In a set, nucleotide sequence species sometimes are in: chromosome 21 and chromosome 18, or are in chromosome 21 and chromosome 13, or are in chromosome 13 and chromosome 18, or are in chromosome 21, and chromosome 18 and chromosome 13, or are in chromosome X, or are in chromosome Y, or are in chromosome X and Y, or are in chromosome 21, chromosome 18 and chromosome 13 and chromosome X or Y, and in about 50%, 60%, 70%, 80%, 90%, 91%, 92%, 93%, 94%, 95%, 96%, 97%, 98%, 99% or 100% of sets, the nucleotide sequence species sometimes are in such designated chromosomes. In certain embodiments, the set utilized, or every set when more than one set is utilized, consists of nucleotide sequence species located in chromosome 21, chromosome 18 and chromosome 13.

In some embodiments, nucleotide sequence species are amplified and base pair mismatches are detected in the resulting amplified nucleic acid species. In other embodiments, the nucleotide sequence species are not amplified prior to detection (e.g., if the detection system is sufficiently sensitive or a sufficient amount of chromosome nucleic acid is available or generated), and nucleotide sequence species are detected directly in chromosome nucleic acid or fragments thereof.

Identification of Nucleotide Sequence Species

In one aspect, the technology in part comprises identifying nucleotide sequence species that amplify in a stable, reproducible manner relative to each other and are thereby useful in conjunction with the methods of the technology. The identification of nucleotide sequence species may be done computationally by identifying sequences which comprises at least about 50%, 60%, 70%, 80%, 90%, 95%, 96%, 97%, 98% or 99% identity over an amplifiable sequence region. In another embodiment, the primer hybridization sequences in the nucleotide sequence species are substantially identical. Often, the nucleotide sequence species comprise a substantially identical GC content (for example, the sequences sometimes have less than about 5% and often, less than about 1% difference in GC content).

Sequence search programs are well known in the art, and include, but are not limited to, BLAST (see, Altschul et al., 1990, J. Mol. Biol. 215: 403-410), BLAT (Kent, W. J. 2002. BLAT—The BLAST-Like Alignment Tool. Genome Research 4: 656-664), FASTA, and SSAHA (see, e.g., Pearson, 1988, Proc. Natl. Acad. Sci. USA 85(5): 2444-2448; Lung et al., 1991, J. Mol. Biol. 221(4): 1367-1378). Further, methods of determining the significance of sequence alignments are known in the art and are described in Needleman and Wunsch, 1970, J. of Mol. Biol. 48: 444; Waterman et al., 1980, J. Mol. Biol. 147: 195-197; Karlin et al., 1990, Proc. Natl. Acad. Sci. USA 87: 2264-2268; and Dembo et al., 1994, Ann. Prob. 22: 2022-2039. While in one aspect, a single query sequence is searched against the database, in another aspect, a plurality of sequences are searched against the database (e.g., using the MEGABLAST program, accessible through NCBI).

A number of human genomic sequence databases exist, including, but not limited to, the NCBI GenBank database and the Genetic Information Research Institute (GIRI) database. Expressed sequence databases include, but are not limited to, the NCBI EST database, the random cDNA sequence database from Human Genome Sciences, and the EMEST8 database (EMBL, Heidelberg, Germany).

While computational methods of identifying suitable nucleotide sequence sets often are utilized, any method of detecting sequences which are capable of significant base pairing can be used to identify or validate nucleotide sequences of the technology. For example, nucleotide sequence sets can be validated using a combination of hybridization-based methods and computational methods to identify sequences which hybridize to multiple chromosomes. The technology is not limited to nucleotide sequences that appear exclusively on target and reference chromosomes. For example, the amplification primers may co-amplify nucleotide sequences from 2, 3, 4, 5, 6 or more chromosomes as long as the amplified nucleic acid species are produced at a reproducible rate and the majority (for example, greater than 60%, 70%, 80%, 90%, 95%, 96%, 97%, 98% or 99%) of the target species comes from the target chromosome, thereby allowing for the accurate detection of target chromosomal abnormalities. As used herein, the terms "target" and "reference" may have a degree of ambiguity since the "target" may be any chromosome that is susceptible to chromosomal abnormalities. For example, a set that consists of nucleotide sequence species from chromosomes 13, 18 and 21 has the power to simultaneously detect a chromosomal abnormality originating from any of the three chromosomes. In the case of a Down Syndrome (trisomy 21) sample, chromosome 21 is the "target chromosome" and chromosomes 13 and 18 are the "reference chromosomes".

Tables 3 and 4 provide examples of non-limiting candidate nucleotide sequence sets, where at least one species of the set is located on chromosome 21, 18 or 13.

Amplification

In some embodiments, nucleotide sequence species are amplified using a suitable amplification process. It may be desirable to amplify nucleotide sequence species particularly if one or more of the nucleotide sequence species exist at low copy number. In some embodiments amplification of sequences or regions of interest may aid in detection of gene dosage imbalances, as might be seen in genetic disorders involving chromosomal aneuploidy, for example. An amplification product (amplicon) of a particular nucleotide sequence species is referred to herein as an "amplified nucleic acid species."

Nucleic acid amplification often involves enzymatic synthesis of nucleic acid amplicons (copies), which contain a sequence complementary to a nucleotide sequence species being amplified. Amplifying nucleotide sequence species and detecting the amplicons synthesized, can improve the sensitivity of an assay, since fewer target sequences are needed at the beginning of the assay, and can improve detection of nucleotide sequence species.

Any suitable amplification technique can be utilized. Amplification of polynucleotides include, but are not limited to, polymerase chain reaction (PCR); ligation amplification (or ligase chain reaction (LCR)); amplification methods based on the use of Q-beta replicase or template-dependent polymerase (see US Patent Publication Number US20050287592); helicase-dependant isothermal amplification (Vincent et al., "Helicase-dependent isothermal DNA amplification". EMBO reports 5 (8): 795-800 (2004)); strand displacement amplification (SDA); thermophilic SDA nucleic acid sequence based amplification (3SR or NASBA) and transcription-associated amplification (TAA). Non-limiting examples of PCR amplification methods include standard PCR, AFLP-PCR, Allele-specific PCR, Alu-PCR, Asymmetric PCR, Colony PCR, Hot start PCR, Inverse PCR (IPCR), In situ PCR (ISH), Intersequence-specific PCR (ISSR-PCR), Long PCR, Multiplex PCR, Nested PCR, Quantitative PCR, Reverse Transcriptase PCR (RT-PCR), Real Time PCR, Single cell PCR, Solid phase PCR, combinations thereof, and the like. Reagents and hardware for conducting PCR are commercially available.

The terms "amplify", "amplification", "amplification reaction", or "amplifying" refers to any in vitro processes for multiplying the copies of a target sequence of nucleic acid. Amplification sometimes refers to an "exponential" increase in target nucleic acid. However, "amplifying" as used herein can also refer to linear increases in the numbers of a select target sequence of nucleic acid, but is different than a one-time, single primer extension step. In some embodiments a limited amplification reaction, also known as pre-amplification, can be performed. Pre-amplification is a method in which a limited amount of amplification occurs due to a small number of cycles, for example 10 cycles, being performed. Pre-amplification can allow some amplification, but stops amplification prior to the exponential phase, and typically produces about 500 copies of the desired nucleotide sequence(s). Use of pre-amplification may also limit inaccuracies associated with depleted reactants in standard PCR reactions, and also may reduce amplification biases due to nucleotide sequence or species abundance of the target. In some embodiments a one-time primer extension may be used may be performed as a prelude to linear or exponential amplification.

A generalized description of an amplification process is presented herein. Primers and target nucleic acid are contacted, and complementary sequences anneal to one another, for example. Primers can anneal to a target nucleic acid, at or near (e.g., adjacent to, abutting, and the like) a sequence of interest. A reaction mixture, containing components necessary for enzymatic functionality, is added to the primer-target nucleic acid hybrid, and amplification can occur under suitable conditions. Components of an amplification reaction may include, but are not limited to, e.g., primers (e.g., individual primers, primer pairs, primer sets and the like) a polynucleotide template (e.g., target nucleic acid), polymerase, nucleotides, dNTPs and the like. In some embodiments, non-naturally occurring nucleotides or nucleotide analogs, such as analogs containing a detectable label (e.g., fluorescent or colorimetric label), may be used for example. Polymerases can be selected by a person of ordinary skill and include polymerases for thermocycle amplification (e.g., Taq DNA Polymerase; Q-Bio™ Taq DNA Polymerase (recombinant truncated form of Taq DNA Polymerase lacking 5'-3'exo activity); SurePrime™ Polymerase (chemically modified Taq DNA polymerase for "hot start" PCR); Arrow™ Taq DNA Polymerase (high sensitivity and long template amplification)) and polymerases for thermostable amplification (e.g., RNA polymerase for transcription-mediated amplification (TMA). Other enzyme components can be added, such as reverse transcriptase for transcription mediated amplification (TMA) reactions, for example.

The terms "near" or "adjacent to" when referring to a nucleotide sequence of interest refers to a distance or region between the end of the primer and the nucleotide or nucleotides of interest. As used herein adjacent is in the range of about 5 nucleotides to about 500 nucleotides (e.g., about 5 nucleotides away from nucleotide of interest, about 10, about 20, about 30, about 40, about 50, about 60, about 70, about 80, about 90, about 100, about 150, about 200, about 250, about 300, abut 350, about 400, about 450 or about 500 nucleotides from a nucleotide of interest). In some embodiments the primers in a set hybridize within about 10 to 30 nucleotides from a nucleic acid sequence of interest and produce amplified products.

Each amplified nucleic acid species independently is about 10 to about 500 base pairs in length in some embodiments. In certain embodiments, an amplified nucleic acid species is about 20 to about 250 base pairs in length, sometimes is about 50 to about 150 base pairs in length and sometimes is about 100 base pairs in length. Thus, in some embodiments, the length of each of the amplified nucleic acid species products independently is about 10, 15, 20, 25, 30, 35, 40, 45, 50, 55, 60, 65, 70, 75, 80, 82, 84, 86, 88, 90, 92, 94, 96, 98, 100, 102, 104, 106, 108, 110, 112, 114, 116, 118, 120, 125, 130, 135, 140, 145, 150, 175, 200, 250, 300, 350, 400, 450, or 500 base pairs (bp) in length.

An amplification product may include naturally occurring nucleotides, non-naturally occurring nucleotides, nucleotide analogs and the like and combinations of the foregoing. An amplification product often has a nucleotide sequence that is identical to or substantially identical to a sample nucleic acid nucleotide sequence or complement thereof. A "substantially identical" nucleotide sequence in an amplification product will generally have a high degree of sequence identity to the nucleotide sequence species being amplified or complement thereof (e.g., about 75%, 76%, 77%, 78%, 79%, 81%, 82%, 83%, 84%, 85%, 86%, 87%, 88%, 89%, 90%, 91%, 92%, 93%, 94%, 95%, 96%, 97%, 98%, 99% or greater than 99% sequence identity), and variations sometimes are a result of infidelity of the polymerase used for extension and/or amplification, or additional nucleotide sequence(s) added to the primers used for amplification.

PCR conditions can be dependent upon primer sequences, target abundance, and the desired amount of amplification, and therefore, one of skill in the art may choose from a number of PCR protocols available (see, e.g., U.S. Pat. Nos. 4,683,195 and 4,683,202; and PCR Protocols: A Guide to Methods and Applications, Innis et al., eds, 1990. Digital PCR is also known to those of skill in the art; see, e.g., US Patent Application Publication Number 20070202525, filed Feb. 2, 2007, which is hereby incorporated by reference). PCR often is carried out as an automated process with a thermostable enzyme. In this process, the temperature of the reaction mixture is cycled through a denaturing region, a primer-annealing region, and an extension reaction region automatically. Machines specifically adapted for this purpose are commercially available. A non-limiting example of a PCR protocol that may be suitable for embodiments described herein is, treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Multiple cycles frequently are performed using a commercially available thermal cycler. Suitable isothermal amplification processes known and selected by the person of ordinary skill in the art also may be applied, in certain embodiments.

In some embodiments, multiplex amplification processes may be used to amplify target nucleic acids, such that multiple amplicons are simultaneously amplified in a single, homogenous reaction. As used herein "multiplex amplification" refers to a variant of PCR where simultaneous amplification of many targets of interest in one reaction vessel may be accomplished by using more than one pair of primers (e.g., more than one primer set). Multiplex amplification may be useful for analysis of deletions, mutations, and polymorphisms, or quantitative assays, in some embodiments. In certain embodiments multiplex amplification may be used for detecting paralog sequence imbalance, genotyping applications where simultaneous analysis of multiple markers is required, detection of pathogens or genetically modified organisms, or for microsatellite analyses. In some embodiments multiplex amplification may be combined with another amplification (e.g., PCR) method (e.g., nested PCR or hot start PCR, for example) to increase amplification specificity and reproducibility. In other embodiments multiplex amplification may be done in replicates, for example, to reduce the variance introduced by said amplification.

In some embodiments amplification nucleic acid species of the primer sets are generated in one reaction vessel. In some embodiments amplification of paralogous sequences may be performed in a single reaction vessel. In certain embodiments, paralogous sequences (on the same or different chromosomes) may be amplified by a single primer pair or set. In some embodiments nucleotide sequence species may be amplified by a single primer pair or set. In some embodiments nucleotide sequence species in a set may be amplified with two or more primer pairs.

In certain embodiments, nucleic acid amplification can generate additional nucleic acid species of different or substantially similar nucleic acid sequence. In certain embodiments described herein, contaminating or additional nucleic acid species, which may contain sequences substantially complementary to, or may be substantially identical to, the sequence of interest, can be useful for sequence quantification, with the proviso that the level of contaminating or additional sequences remains constant and therefore can be a reliable marker whose level can be substantially reproduced. Additional considerations that may affect sequence amplification reproducibility are; PCR conditions (number of cycles, volume of reactions, melting temperature difference between primers pairs, and the like), concentration of target nucleic acid in sample (e.g. fetal nucleic acid in maternal nucleic acid background, viral nucleic acid in host background), the number of chromosomes on which the nucleotide species of interest resides (e.g., paralogous sequence), variations in quality of prepared sample, and the like. The terms "substantially reproduced" or "substantially reproducible" as used herein refer to a result (e.g., quantifiable amount of nucleic acid) that under substantially similar conditions would occur in substantially the same way about 75% of the time or greater, about 80%, about 85%, about 90%, about 95%, or about 99% of the time or greater.

In some embodiments where a target nucleic acid is RNA, prior to the amplification step, a DNA copy (cDNA) of the RNA transcript of interest may be synthesized. A cDNA can be synthesized by reverse transcription, which can be carried out as a separate step, or in a homogeneous reverse transcription-polymerase chain reaction (RT-PCR), a modification of the polymerase chain reaction for amplifying RNA. Methods suitable for PCR amplification of ribonucleic acids are described by Romero and Rotbart in Diagnostic Molecular Biology: Principles and Applications pp. 401-406; Persing et al., eds., Mayo Foundation, Rochester, Minn., 1993; Egger et al., J. Clin. Microbiol. 33:1442-1447, 1995; and U.S. Pat. No. 5,075,212. Branched-DNA technology may be used to amplify the signal of RNA markers in maternal blood. For a review of branched-DNA (bDNA) signal amplification for direct quantification of nucleic acid sequences in clinical samples, see Nolte, Adv. Clin. Chem. 33:201-235, 1998.

Amplification also can be accomplished using digital PCR, in certain embodiments (e.g., Kalinina and colleagues (Kalinina et al., "Nanoliter scale PCR with TaqMan detection." Nucleic Acids Research. 25; 1999-2004, (1997); Vogelstein and Kinzler (Digital PCR. Proc Natl Acad Sci USA. 96; 9236-41, (1999); PCT Patent Publication No. WO05023091A2; US Patent Publication No. US 20070202525). Digital PCR takes advantage of nucleic acid (DNA, cDNA or RNA) amplification on a single molecule level, and offers a highly sensitive method for quantifying low copy number nucleic acid. Systems for digital amplification and analysis of nucleic acids are available (e.g., Fluidigm® Corporation).

Use of a primer extension reaction also can be applied in methods of the technology. A primer extension reaction operates, for example, by discriminating nucleic acid sequences at a single nucleotide mismatch (e.g., a mismatch between paralogous sequences). The mismatch is detected by the incorporation of one or more deoxynucleotides and/or dideoxynucleotides to an extension oligonucleotide, which hybridizes to a region adjacent to the mismatch site. The extension oligonucleotide generally is extended with a polymerase. In some embodiments, a detectable tag or detectable label is incorporated into the extension oligonucleotide or into the nucleotides added on to the extension oligonucleotide (e.g., biotin or streptavidin). The extended oligonucleotide can be detected by any known suitable detection process (e.g., mass spectrometry; sequencing processes). In some embodiments, the mismatch site is extended only by one or two complementary deoxynucleotides or dideoxynucleotides that are tagged by a specific label or generate a primer extension product with a specific mass, and the mismatch can be discriminated and quantified.

In some embodiments, amplification may be performed on a solid support. In some embodiments, primers may be associated with a solid support. In certain embodiments, target nucleic acid (e.g., template nucleic acid) may be associated with a solid support. A nucleic acid (primer or target) in association with a solid support often is referred to as a solid phase nucleic acid.

In some embodiments, nucleic acid molecules provided for amplification and in a "microreactor". As used herein, the term "microreactor" refers to a partitioned space in which a nucleic acid molecule can hybridize to a solid support nucleic acid molecule. Examples of microreactors include, without limitation, an emulsion globule (described hereafter) and a void in a substrate. A void in a substrate can be a pit, a pore or a well (e.g., microwell, nanowell, picowell, micropore, or nanopore) in a substrate constructed from a solid material useful for containing fluids (e.g., plastic (e.g., polypropylene, polyethylene, polystyrene) or silicon) in certain embodiments. Emulsion globules are partitioned by an immiscible phase as described in greater detail hereafter. In some embodiments, the microreactor volume is large enough to accommodate one solid support (e.g., bead) in the microreactor and small enough to exclude the presence of two or more solid supports in the microreactor.

The term "emulsion" as used herein refers to a mixture of two immiscible and unblendable substances, in which one substance (the dispersed phase) often is dispersed in the other substance (the continuous phase). The dispersed phase can be an aqueous solution (i.e., a solution comprising water) in certain embodiments. In some embodiments, the dispersed phase is composed predominantly of water (e.g., greater than 70%, greater than 75%, greater than 80%, greater than 85%, greater than 90%, greater than 95%, greater than 97%, greater than 98% and greater than 99% water (by weight)). Each discrete portion of a dispersed phase, such as an aqueous dispersed phase, is referred to herein as a "globule" or "microreactor." A globule sometimes may be spheroidal, substantially spheroidal or semi-spheroidal in shape, in certain embodiments.

The terms "emulsion apparatus" and "emulsion component(s)" as used herein refer to apparatus and components that can be used to prepare an emulsion. Non-limiting examples of emulsion apparatus include without limitation counter-flow, cross-current, rotating drum and membrane apparatus suitable for use by a person of ordinary skill to prepare an emulsion. An emulsion component forms the continuous phase of an emulsion in certain embodiments, and includes without limitation a substance immiscible with water, such as a component comprising or consisting essentially of an oil (e.g., a heat-stable, biocompatible oil (e.g., light mineral oil)). A biocompatible emulsion stabilizer can be utilized as an emulsion component. Emulsion stabilizers include without limitation Atlox 4912, Span 80 and other biocompatible surfactants.

In some embodiments, components useful for biological reactions can be included in the dispersed phase. Globules of the emulsion can include (i) a solid support unit (e.g., one bead or one particle); (ii) sample nucleic acid molecule; and (iii) a sufficient amount of extension agents to elongate solid phase nucleic acid and amplify the elongated solid phase nucleic acid (e.g., extension nucleotides, polymerase, primer). Inactive globules in the emulsion may include a subset of these components (e.g., solid support and extension reagents and no sample nucleic acid) and some can be empty (i.e., some globules will include no solid support, no sample nucleic acid and no extension agents).

Emulsions may be prepared using known suitable methods (e.g., Nakano et al. "Single-molecule PCR using water-in-oil emulsion;" Journal of Biotechnology 102 (2003) 117-124). Emulsification methods include without limitation adjuvant methods, counter-flow methods, cross-current methods, rotating drum methods, membrane methods, and the like. In certain embodiments, an aqueous reaction mixture containing a solid support (hereafter the "reaction mixture") is prepared and then added to a biocompatible oil. In certain embodiments, the reaction mixture may be added dropwise into a spinning mixture of biocompatible oil (e.g., light mineral oil (Sigma)) and allowed to emulsify. In some embodiments, the reaction mixture may be added dropwise into a cross-flow of biocompatible oil. The size of aqueous globules in the emulsion can be adjusted, such as by varying the flow rate and speed at which the components are added to one another, for example.

The size of emulsion globules can be selected by the person of ordinary skill in certain embodiments based on two competing factors: (i) globules are sufficiently large to encompass one solid support molecule, one sample nucleic acid molecule, and sufficient extension agents for the degree of elongation and amplification required; and (ii) globules are sufficiently small so that a population of globules can be amplified by conventional laboratory equipment (e.g., thermocycling equipment, test tubes, incubators and the like). Globules in the emulsion can have a nominal, mean or average diameter of about 5 microns to about 500 microns, about 10 microns to about 350 microns, about 50 to 250 microns, about 100 microns to about 200 microns, or about 5, 10, 15, 20, 25, 30, 35, 40, 45, 50, 55, 60, 65, 70, 75, 80, 85, 90, 95, 100, 200, 300, 400 or 500 microns in certain embodiments.

In certain embodiments, amplified nucleic acid species in a set are of identical length, and sometimes the amplified nucleic acid species in a set are of a different length. For example, one amplified nucleic acid species may be longer than one or more other amplified nucleic acid species in the set by about 1 to about 100 nucleotides (e.g., about 2, 3, 4, 5, 6, 7, 8, 9, 10, 11, 12, 13, 14, 15, 16, 17, 18, 19, 20, 30, 40, 50, 60, 70, 80 or 90 nucleotides longer).

In some embodiments, a ratio can be determined for the amount of one amplified nucleic acid species in a set to the amount of another amplified nucleic acid species in the set (hereafter a "set ratio"). In some embodiments, the amount of one amplified nucleic acid species in a set is about equal to the amount of another amplified nucleic acid species in the set (i.e., amounts of amplified nucleic acid species in a set are about 1:1), which generally is the case when the number of chromosomes in a sample bearing each nucleotide sequence species amplified is about equal. The term "amount" as used herein with respect to amplified nucleic acid species refers to any suitable measurement, including, but not limited to, copy number, weight (e.g., grams) and concentration (e.g., grams per unit volume (e.g., milliliter); molar units). In certain embodiments, the amount of one amplified nucleic acid species in a set can differ from the amount of another amplified nucleic acid species in a set, even when the number of chromosomes in a sample bearing each nucleotide sequence species amplified is about equal. In some embodiments, amounts of amplified nucleic acid species within a set may vary up to a threshold level at which a chromosome abnormality can be detected with a confidence level of about 95% (e.g., about 90, 91, 92, 93, 94, 95, 96, 97, 98, 99, or greater than 99%). In certain embodiments, the amounts of the amplified nucleic acid species in a set vary by about 50% or less (e.g., about 45, 40, 35, 30, 25, 20, 15, 10, 5, 4, 3, 2 or 1%, or less than 1%). Thus, in certain embodiments amounts of amplified nucleic acid species in a set may vary from about 1:1 to about 1:1.5. Without being limited by theory, certain factors can lead to the observation that the amount of one amplified nucleic acid species in a set can differ from the amount of another amplified nucleic acid species in a set, even when the number of chromosomes in a sample bearing each nucleotide sequence species amplified is about equal. Such factors may include different amplification efficiency rates and/or amplification from a chromosome not intended in the assay design.

Each amplified nucleic acid species in a set generally is amplified under conditions that amplify that species at a substantially reproducible level. The term "substantially reproducible level" as used herein refers to consistency of amplification levels for a particular amplified nucleic acid species per unit template nucleic acid (e.g., per unit template nucleic acid that contains the particular nucleotide sequence species amplified). A substantially reproducible level varies by about 1% or less in certain embodiments, after factoring the amount of template nucleic acid giving rise to a particular amplification nucleic acid species (e.g., normalized for the amount of template nucleic acid). In some embodiments, a substantially reproducible level varies by 10%, 5%, 4%, 3%, 2%, 1.5%, 1%, 0.5%, 0.1%, 0.05%, 0.01%, 0.005% or 0.001% after factoring the amount of template nucleic acid giving rise to a particular amplification nucleic acid species. Alternatively, substantially reproducible means that any two or more measurements of an amplification level are within a particular coefficient of variation ("CV") from a given mean. Such CV may be 20% or less, sometimes 10% or less and at times 5% or less. The two or more measurements of an amplification level may be determined between two or more reactions and/or two or more of the same sample types (for example, two normal samples or two trisomy samples) Primers Primers useful for detection, quantification, amplification, sequencing and analysis of nucleotide sequence species are provided. In some embodiments primers are used in sets, where a set contains at least a pair. In some embodiments a set of primers may include a third or a fourth nucleic acid (e.g., two pairs of primers or nested sets of primers, for example). A plurality of primer pairs may constitute a primer set in certain embodiments (e.g., about 2, 3, 4, 5, 6, 7, 8, 9, 10, 15, 20, 25, 30, 35, 40, 45, 50, 55, 60, 65, 70, 75, 80, 85, 90, 95 or 100 pairs). In some embodiments a plurality of primer sets, each set comprising pair(s) of primers, may be used. The term "primer" as used herein refers to a nucleic acid that comprises a nucleotide sequence capable of hybridizing or annealing to a target nucleic acid, at or near (e.g., adjacent to) a specific region of interest. Primers can allow for specific determination of a target nucleic acid nucleotide sequence or detection of the target nucleic acid (e.g., presence or absence of a sequence or copy number of a sequence), or feature thereof, for example. A primer may be naturally occurring or synthetic. The term "specific" or "specificity", as used herein, refers to the binding or hybridization of one molecule to another molecule, such as a primer for a target polynucleotide. That is, "specific" or "specificity" refers to the recognition, contact, and formation of a stable complex between two molecules, as compared to substantially less recognition, contact, or complex formation of either of those two molecules with other molecules. As used herein, the term "anneal" refers to the formation of a stable complex between two molecules. The terms "primer", "oligo", or "oligonucleotide" may be used interchangeably throughout the document, when referring to primers.

A primer nucleic acid can be designed and synthesized using suitable processes, and may be of any length suitable for hybridizing to a nucleotide sequence of interest (e.g., where the nucleic acid is in liquid phase or bound to a solid support) and performing analysis processes described herein. Primers may be designed based upon a target nucleotide sequence. A primer in some embodiments may be about 10 to about 100 nucleotides, about 10 to about 70 nucleotides, about 10 to about 50 nucleotides, about 15 to about 30 nucleotides, or about 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95 or 100 nucleotides in length. A primer may be composed of naturally occurring and/or non-naturally occurring nucleotides (e.g., labeled nucleotides), or a mixture thereof. Primers suitable for use with embodiments described herein, may be synthesized and labeled using known techniques. Oligonucleotides (e.g., primers) may be chemically synthesized according to the solid phase phosphoramidite triester method first described by Beaucage and Caruthers, Tetrahedron Letts., 22:1859-1862, 1981, using an automated synthesizer, as described in Needham-VanDevanter et al., Nucleic Acids Res. 12:6159-6168, 1984. Purification of oligonucleotides can be effected by native acrylamide gel electrophoresis or by anion-exchange high-performance liquid chromatography (HPLC), for example, as described in Pearson and Regnier, J. Chrom., 255:137-149, 1983.

All or a portion of a primer nucleic acid sequence (naturally occurring or synthetic) may be substantially complementary to a target nucleic acid, in some embodiments. As referred to herein, "substantially complementary" with respect to sequences refers to nucleotide sequences that will hybridize with each other. The stringency of the hybridization conditions can be altered to tolerate varying amounts of sequence mismatch. Included are regions of counterpart, target and capture nucleotide sequences 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more or 99% or more complementary to each other.

Primers that are substantially complimentary to a target nucleic acid sequence are also substantially identical to the compliment of the target nucleic acid sequence. That is, primers are substantially identical to the anti-sense strand of the nucleic acid. As referred to herein, "substantially identical" with respect to sequences refers to nucleotide sequences that are 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more or 99% or more identical to each other. One test for determining whether two nucleotide sequences are substantially identical is to determine the percent of identical nucleotide sequences shared.

Primer sequences and length may affect hybridization to target nucleic acid sequences. Depending on the degree of mismatch between the primer and target nucleic acid, low, medium or high stringency conditions may be used to effect primer/target annealing. As used herein, the term "stringent conditions" refers to conditions for hybridization and washing. Methods for hybridization reaction temperature condition optimization are known to those of skill in the art, and may be found in Current Protocols in Molecular Biology, John Wiley & Sons, N.Y., 6.3.1-6.3.6 (1989). Aqueous and non-aqueous methods are described in that reference and either can be used. Non-limiting examples of stringent hybridization conditions are hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions is hybridization in 6× sodium chloride/sodium citrate (SSC) at about 45° C., followed by one or more washes in 0.2×SSC, 0.1% SDS at 60° C. Often, stringent hybridization conditions are hybridization in 6× sodium chloride/sodium citrate (SSC) at about 45° C., followed by one or more washes in 0.2×SSC, 0.1% SDS at 65° C. More often, stringency conditions are 0.5M sodium phosphate, 7% SDS at 65° C., followed by one or more washes at 0.2×SSC, 1% SDS at 65° C. Stringent hybridization temperatures can also be altered (i.e. lowered) with the addition of certain organic solvents, formamide for example. Organic solvents, like formamide, reduce the thermal stability of double-stranded polynucleotides, so that hybridization can be performed at lower temperatures, while still maintaining stringent conditions and extending the useful life of nucleic acids that may be heat labile.

As used herein, the phrase "hybridizing" or grammatical variations thereof, refers to binding of a first nucleic acid molecule to a second nucleic acid molecule under low, medium or high stringency conditions, or under nucleic acid synthesis conditions. Hybridizing can include instances where a first nucleic acid molecule binds to a second nucleic acid molecule, where the first and second nucleic acid molecules are complementary. As used herein, "specifically hybridizes" refers to preferential hybridization under nucleic acid synthesis conditions of a primer, to a nucleic acid molecule having a sequence complementary to the primer compared to hybridization to a nucleic acid molecule not having a complementary sequence. For example, specific hybridization includes the hybridization of a primer to a target nucleic acid sequence that is complementary to the primer.

In some embodiments primers can include a nucleotide subsequence that may be complementary to a solid phase nucleic acid primer hybridization sequence or substantially complementary to a solid phase nucleic acid primer hybridization sequence (e.g., about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater than 99% identical to the primer hybridization sequence complement when aligned). A primer may contain a nucleotide subsequence not complementary to or not substantially complementary to a solid phase nucleic acid primer hybridization sequence (e.g., at the 3' or 5' end of the nucleotide subsequence in the primer complementary to or substantially complementary to the solid phase primer hybridization sequence).

A primer, in certain embodiments, may contain a modification such as inosines, abasic sites, locked nucleic acids, minor groove binders, duplex stabilizers (e.g., acridine, spermidine), Tm modifiers or any modifier that changes the binding properties of the primers or probes.

A primer, in certain embodiments, may contain a detectable molecule or entity (e.g., a fluorophore, radioisotope, colorimetric agent, particle, enzyme and the like). When desired, the nucleic acid can be modified to include a detectable label using any method known to one of skill in the art. The label may be incorporated as part of the synthesis, or added on prior to using the primer in any of the processes described herein. Incorporation of label may be performed either in liquid phase or on solid phase. In some embodiments the detectable label may be useful for detection of targets. In some embodiments the detectable label may be useful for the quantification target nucleic acids (e.g., determining copy number of a particular sequence or species of nucleic acid). Any detectable label suitable for detection of an interaction or biological activity in a system can be appropriately selected and utilized by the artisan. Examples of detectable labels are fluorescent labels such as fluorescein, rhodamine, and others (e.g., Anantha, et al., Biochemistry (1998) 37:2709 2714; and Qu & Chaires, Methods Enzymol. (2000) 321:353 369); radioactive isotopes (e.g., 125I, 131I, 35S, 31P, 32P, 33P, 14C, 3H, 7Be, 28Mg, 57Co, 65Zn, 67Cu, 68Ge, 82Sr, 83Rb, 95Tc, 96Tc, 103Pd, 109Cd, and 127Xe); light scattering labels (e.g., U.S. Pat. No. 6,214,560, and commercially available from Genicon Sciences Corporation, CA); chemiluminescent labels and enzyme substrates (e.g., dioxetanes and acridinium esters), enzymic or protein labels (e.g., green fluorescence protein (GFP) or color variant thereof, luciferase, peroxidase); other chromogenic labels or dyes (e.g., cyanine), and other cofactors or biomolecules such as digoxigenin, strepdavidin, biotin (e.g., members of a binding pair such as biotin and avidin for example), affinity capture moieties and the like. In some embodiments a primer may be labeled with an affinity capture moiety. Also included in detectable labels are those labels useful for mass modification for detection with mass spectrometry (e.g., matrix-assisted laser desorption ionization (MALDI) mass spectrometry and electrospray (ES) mass spectrometry).

A primer also may refer to a polynucleotide sequence that hybridizes to a subsequence of a target nucleic acid or another primer and facilitates the detection of a primer, a target nucleic acid or both, as with molecular beacons, for example. The term "molecular beacon" as used herein refers to detectable molecule, where the detectable property of the molecule is detectable only under certain specific conditions, thereby enabling it to function as a specific and informative signal. Non-limiting examples of detectable properties are, optical properties, electrical properties, magnetic properties, chemical properties and time or speed through an opening of known size.

In some embodiments a molecular beacon can be a single-stranded oligonucleotide capable of forming a stem-loop structure, where the loop sequence may be complementary to a target nucleic acid sequence of interest and is flanked by short complementary arms that can form a stem. The oligonucleotide may be labeled at one end with a fluorophore and at the other end with a quencher molecule. In the stem-loop conformation, energy from the excited fluorophore is transferred to the quencher, through long-range dipole-dipole coupling similar to that seen in fluorescence resonance energy transfer, or FRET, and released as heat instead of light. When the loop sequence is hybridized to a specific target sequence, the two ends of the molecule are separated and the energy from the excited fluorophore is emitted as light, generating a detectable signal. Molecular beacons offer the added advantage that removal of excess probe is unnecessary due to the self-quenching nature of the unhybridized probe. In some embodiments molecular beacon probes can be designed to either discriminate or tolerate mismatches between the loop and target sequences by modulating the relative strengths of the loop-target hybridization and stem formation. As referred to herein, the term "mismatched nucleotide" or a "mismatch" refers to a nucleotide that is not complementary to the target sequence at that position or positions. A probe may have at least one mismatch, but can also have 2, 3, 4, 5, 6 or 7 or more mismatched nucleotides.

Detection

Nucleotide sequence species, or amplified nucleic acid species, or detectable products prepared from the foregoing, can be detected by a suitable detection process. Non-limiting examples of methods of detection, quantification, sequencing and the like include mass detection of mass modified amplicons (e.g., matrix-assisted laser desorption ionization (MALDI) mass spectrometry and electrospray (ES) mass spectrometry), a primer extension method (e.g., iPLEX™; Sequenom, Inc.), direct DNA sequencing, Molecular Inversion Probe (MIP) technology from Affymetrix, restriction fragment length polymorphism (RFLP analysis), allele specific oligonucleotide (ASO) analysis, methylation-specific PCR (MSPCR), pyrosequencing analysis, acycloprime analysis, Reverse dot blot, GeneChip microarrays, Dynamic allele-specific hybridization (DASH), Peptide nucleic acid (PNA) and locked nucleic acids (LNA) probes, TaqMan, Molecular Beacons, Intercalating dye, FRET primers, AlphaScreen, SNPstream, genetic bit analysis (GBA), Multiplex minisequencing, SNaPshot, GOOD assay, Microarray miniseq, arrayed primer extension (APEX), Microarray primer extension, Tag arrays, Coded microspheres, Template-directed incorporation (TDI), fluorescence polarization, Colorimetric oligonucleotide ligation assay (OLA), Sequence-coded OLA, Microarray ligation, Ligase chain reaction, Padlock probes, Invader assay, hybridization using at least one probe, hybridization using at least one fluorescently labeled probe, cloning and sequencing, electrophoresis, the use of hybridization probes and quantitative real time polymerase chain reaction (QRT-PCR), digital PCR, nanopore sequencing, chips and combinations thereof. The detection and quantification of alleles or paralogs can be carried out using the "closed-tube" methods described in U.S. patent application Ser. No. 11/950,395, which was filed Dec. 4, 2007. In some embodiments the amount of each amplified nucleic acid species is determined by mass spectrometry, primer extension, sequencing (e.g., any suitable method, for example nanopore or pyrosequencing), Quantitative PCR (Q-PCR or QRT-PCR), digital PCR, combinations thereof, and the like.

A target nucleic acid can be detected by detecting a detectable label or "signal-generating moiety" in some embodiments. The term "signal-generating" as used herein refers to any atom or molecule that can provide a detectable or quantifiable effect, and that can be attached to a nucleic acid. In certain embodiments, a detectable label generates a unique light signal, a fluorescent signal, a luminescent signal, an electrical property, a chemical property, a magnetic property and the like.

Detectable labels include, but are not limited to, nucleotides (labeled or unlabelled), compomers, sugars, peptides, proteins, antibodies, chemical compounds, conducting polymers, binding moieties such as biotin, mass tags, colorimetric agents, light emitting agents, chemiluminescent agents, light scattering agents, fluorescent tags, radioactive tags, charge tags (electrical or magnetic charge), volatile tags and hydrophobic tags, biomolecules (e.g., members of a binding pair antibody/antigen, antibody/antibody, antibody/antibody fragment, antibody/antibody receptor, antibody/protein A or protein G, hapten/anti-hapten, biotin/avidin, biotin/streptavidin, folic acid/folate binding protein, vitamin B12/intrinsic factor, chemical reactive group/complementary chemical reactive group (e.g., sulfhydryl/maleimide, sulfhydryl/haloacetyl derivative, amine/isotriocyanate, amine/succinimidyl ester, and amine/sulfonyl halides) and the like, some of which are further described below. In some embodiments a probe may contain a signal-generating moiety that hybridizes to a target and alters the passage of the target nucleic acid through a nanopore, and can generate a signal when released from the target nucleic acid when it passes through the nanopore (e.g., alters the speed or time through a pore of known size).

In certain embodiments, sample tags are introduced to distinguish between samples (e.g., from different patients), thereby allowing for the simultaneous testing of multiple samples. For example, sample tags may introduced as part of the extend primers such that extended primers can be associated with a particular sample.

A solution containing amplicons produced by an amplification process, or a solution containing extension products produced by an extension process, can be subjected to further processing. For example, a solution can be contacted with an agent that removes phosphate moieties from free nucleotides that have not been incorporated into an amplicon or extension product. An example of such an agent is a phosphatase (e.g., alkaline phosphatase). Amplicons and extension products also may be associated with a solid phase, may be washed, may be contacted with an agent that removes a terminal phosphate (e.g., exposure to a phosphatase), may be contacted with an agent that removes a terminal nucleotide (e.g., exonuclease), may be contacted with an agent that cleaves (e.g., endonuclease, ribonuclease), and the like.

The term "solid support" or "solid phase" as used herein refers to an insoluble material with which nucleic acid can be associated. Examples of solid supports for use with processes described herein include, without limitation, arrays, beads (e.g., paramagnetic beads, magnetic beads, microbeads, nanobeads) and particles (e.g., microparticles, nanoparticles). Particles or beads having a nominal, average or mean diameter of about 1 nanometer to about 500 micrometers can be utilized, such as those having a nominal, mean or average diameter, for example, of about 10 nanometers to about 100 micrometers; about 100 nanometers to about 100 micrometers; about 1 micrometer to about 100 micrometers; about 10 micrometers to about 50 micrometers; about 1, 5, 10, 15, 20, 25, 30, 35, 40, 45, 50, 55, 60, 65, 70, 75, 80, 85, 90, 95, 100, 200, 300, 400, 500, 600, 700, 800 or 900 nanometers; or about 1, 5, 10, 15, 20, 25, 30, 35, 40, 45, 50, 55, 60, 65, 70, 75, 80, 85, 90, 95, 100, 200, 300, 400, 500 micrometers.

A solid support can comprise virtually any insoluble or solid material, and often a solid support composition is selected that is insoluble in water. For example, a solid support can comprise or consist essentially of silica gel, glass (e.g. controlled-pore glass (CPG)), nylon, Sephadex®, Sepharose®, cellulose, a metal surface (e.g. steel, gold, silver, aluminum, silicon and copper), a magnetic material, a plastic material (e.g., polyethylene, polypropylene, polyamide, polyester, polyvinylidenedifluoride (PVDF)) and the like. Beads or particles may be swellable (e.g., polymeric beads such as Wang resin) or non-swellable (e.g., CPG). Commercially available examples of beads include without limitation Wang resin, Merrifield resin and Dynabeads® and SoluLink.

A solid support may be provided in a collection of solid supports. A solid support collection comprises two or more different solid support species. The term "solid support species" as used herein refers to a solid support in association with one particular solid phase nucleic acid species or a particular combination of different solid phase nucleic acid species. In certain embodiments, a solid support collection comprises 2 to 10,000 solid support species, 10 to 1,000 solid support species or about 2, 3, 4, 5, 6, 7, 8, 9, 10, 15, 20, 25, 30, 35, 40, 45, 50, 55, 60, 65, 70, 75, 80, 85, 90, 95, 100, 200, 300, 400, 500, 600, 700, 800, 900, 1000, 2000, 3000, 4000, 5000, 6000, 7000, 8000, 9000 or 10000 unique solid support species. The solid supports (e.g., beads) in the collection of solid supports may be homogeneous (e.g., all are Wang resin beads) or heterogeneous (e.g., some are Wang resin beads and some are magnetic beads). Each solid support species in a collection of solid supports sometimes is labeled with a specific identification tag. An identification tag for a particular solid support species sometimes is a nucleic acid (e.g., "solid phase nucleic acid") having a unique sequence in certain embodiments. An identification tag can be any molecule that is detectable and distinguishable from identification tags on other solid support species.

Nucleotide sequence species, amplified nucleic acid species, or detectable products generated from the foregoing may be subject to sequence analysis. The term "sequence analysis" as used herein refers to determining a nucleotide sequence of an amplification product. The entire sequence or a partial sequence of an amplification product can be determined, and the determined nucleotide sequence is referred to herein as a "read." For example, linear amplification products may be analyzed directly without further amplification in some embodiments (e.g., by using single-molecule sequencing methodology (described in greater detail hereafter)). In certain embodiments, linear amplification products may be subject to further amplification and then analyzed (e.g., using sequencing by ligation or pyrosequencing methodology (described in greater detail hereafter)). Reads may be subject to different types of sequence analysis. Any suitable sequencing method can be utilized to detect, and determine the amount of, nucleotide sequence species, amplified nucleic acid species, or detectable products generated from the foregoing. In one embodiment, a heterogeneous sample is subjected to targeted sequencing (or partial targeted sequencing) where one or more sets of nucleic acid species are sequenced, and the amount of each sequenced nucleic acid species in the set is determined, whereby the presence or absence of a chromosome abnormality is identified based on the amount of the sequenced nucleic acid species Examples of certain sequencing methods are described hereafter.

The terms "sequence analysis apparatus" and "sequence analysis component(s)" used herein refer to apparatus, and one or more components used in conjunction with such apparatus, that can be used by a person of ordinary skill to determine a nucleotide sequence from amplification products resulting from processes described herein (e.g., linear and/or exponential amplification products). Examples of sequencing platforms include, without limitation, the 454 platform (Roche) (Margulies, M. et al. 2005 Nature 437, 376-380), Illumina Genomic Analyzer (or Solexa platform) or SOLID System (Applied Biosystems) or the Helicos True Single Molecule DNA sequencing technology (Harris T D et al. 2008 Science, 320, 106-109), the single molecule, real-time (SMRT™) technology of Pacific Biosciences, and nanopore sequencing (Soni G V and Meller A. 2007 Clin Chem 53: 1996-2001). Such platforms allow sequencing of many nucleic acid molecules isolated from a specimen at high orders of multiplexing in a parallel manner (Dear Brief Funct Genomic Proteomic 2003; 1: 397-416). Each of these platforms allow sequencing of clonally expanded or non-amplified single molecules of nucleic acid fragments. Certain platforms involve, for example, (i) sequencing by ligation of dye-modified probes (including cyclic ligation and cleavage), (ii) pyrosequencing, and (iii) single-molecule sequencing. Nucleotide sequence species, amplification nucleic acid species and detectable products generated there from can be considered a "study nucleic acid" for purposes of analyzing a nucleotide sequence by such sequence analysis platforms.

Sequencing by ligation is a nucleic acid sequencing method that relies on the sensitivity of DNA ligase to base-pairing mismatch. DNA ligase joins together ends of DNA that are correctly base paired. Combining the ability of DNA ligase to join together only correctly base paired DNA ends, with mixed pools of fluorescently labeled oligonucleotides or primers, enables sequence determination by fluorescence detection. Longer sequence reads may be obtained by including primers containing cleavable linkages that can be cleaved after label identification. Cleavage at the linker removes the label and regenerates the 5' phosphate on the end of the ligated primer, preparing the primer for another round of ligation. In some embodiments primers may be labeled with more than one fluorescent label (e.g., 1 fluorescent label, 2, 3, or 4 fluorescent labels).

An example of a system that can be used by a person of ordinary skill based on sequencing by ligation generally involves the following steps. Clonal bead populations can be prepared in emulsion microreactors containing study nucleic acid ("template"), amplification reaction components, beads and primers. After amplification, templates are denatured and bead enrichment is performed to separate beads with extended templates from undesired beads (e.g., beads with no extended templates). The template on the selected beads undergoes a 3' modification to allow covalent bonding to the slide, and modified beads can be deposited onto a glass slide. Deposition chambers offer the ability to segment a slide into one, four or eight chambers during the bead loading process. For sequence analysis, primers hybridize to the adapter sequence. A set of four color dye-labeled probes competes for ligation to the sequencing primer. Specificity of probe ligation is achieved by interrogating every 4th and 5th base during the ligation series. Five to seven rounds of ligation, detection and cleavage record the color at every 5th position with the number of rounds determined by the type of library used. Following each round of ligation, a new complimentary primer offset by one base in the 5' direction is laid down for another series of ligations. Primer reset and ligation rounds (5-7 ligation cycles per round) are repeated sequentially five times to generate 25-35 base pairs of sequence for a single tag. With mate-paired sequencing, this process is repeated for a second tag. Such a system can be used to exponentially amplify amplification products generated by a process described herein, e.g., by ligating a heterologous nucleic acid to the first amplification product generated by a process described herein and performing emulsion amplification using the same or a different solid support originally used to generate the first amplification product. Such a system also may be used to analyze amplification products directly generated by a process described herein by bypassing an exponential amplification process and directly sorting the solid supports described herein on the glass slide.

Pyrosequencing is a nucleic acid sequencing method based on sequencing by synthesis, which relies on detection of a pyrophosphate released on nucleotide incorporation. Generally, sequencing by synthesis involves synthesizing, one nucleotide at a time, a DNA strand complimentary to the strand whose sequence is being sought. Study nucleic acids may be immobilized to a solid support, hybridized with a sequencing primer, incubated with DNA polymerase, ATP sulfurylase, luciferase, apyrase, adenosine 5' phosphsulfate and luciferin. Nucleotide solutions are sequentially added and removed. Correct incorporation of a nucleotide releases a pyrophosphate, which interacts with ATP sulfurylase and produces ATP in the presence of adenosine 5' phosphsulfate, fueling the luciferin reaction, which produces a chemiluminescent signal allowing sequence determination.

An example of a system that can be used by a person of ordinary skill based on pyrosequencing generally involves the following steps: ligating an adaptor nucleic acid to a study nucleic acid and hybridizing the study nucleic acid to a bead; amplifying a nucleotide sequence in the study nucleic acid in an emulsion; sorting beads using a picoliter multiwell solid support; and sequencing amplified nucleotide sequences by pyrosequencing methodology (e.g., Nakano et al., "Single-molecule PCR using water-in-oil emulsion;" Journal of Biotechnology 102: 117-124 (2003)). Such a system can be used to exponentially amplify amplification products generated by a process described herein, e.g., by ligating a heterologous nucleic acid to the first amplification product generated by a process described herein.

Certain single-molecule sequencing embodiments are based on the principal of sequencing by synthesis, and utilize single-pair Fluorescence Resonance Energy Transfer (single pair FRET) as a mechanism by which photons are emitted as a result of successful nucleotide incorporation. The emitted photons often are detected using intensified or high sensitivity cooled charge-couple-devices in conjunction with total internal reflection microscopy (TIRM). Photons are only emitted when the introduced reaction solution contains the correct nucleotide for incorporation into the growing nucleic acid chain that is synthesized as a result of the sequencing process. In FRET based single-molecule sequencing, energy is transferred between two fluorescent dyes, sometimes polymethine cyanine dyes Cy3 and Cy5, through long-range dipole interactions. The donor is excited at its specific excitation wavelength and the excited state energy is transferred, non-radiatively to the acceptor dye, which in turn becomes excited. The acceptor dye eventually returns to the ground state by radiative emission of a photon. The two dyes used in the energy transfer process represent the "single pair", in single pair FRET. Cy3 often is used as the donor fluorophore and often is incorporated as the first labeled nucleotide. Cy5 often is used as the acceptor fluorophore and is used as the nucleotide label for successive nucleotide additions after incorporation of a first Cy3 labeled nucleotide. The fluorophores generally are within 10 nanometers of each for energy transfer to occur successfully.

An example of a system that can be used based on single-molecule sequencing generally involves hybridizing a primer to a study nucleic acid to generate a complex; associating the complex with a solid phase; iteratively extending the primer by a nucleotide tagged with a fluorescent molecule; and capturing an image of fluorescence resonance energy transfer signals after each iteration (e.g., U.S. Pat. No. 7,169,314; Braslaysky et al., PNAS 100(7): 3960-3964 (2003)). Such a system can be used to directly sequence amplification products generated by processes described herein. In some embodiments the released linear amplification product can be hybridized to a primer that contains sequences complementary to immobilized capture sequences present on a solid support, a bead or glass slide for example. Hybridization of the primer-released linear amplification product complexes with the immobilized capture sequences, immobilizes released linear amplification products to solid supports for single pair FRET based sequencing by synthesis. The primer often is fluorescent, so that an initial reference image of the surface of the slide with immobilized nucleic acids can be generated. The initial reference image is useful for determining locations at which true nucleotide incorporation is occurring. Fluorescence signals detected in array locations not initially identified in the "primer only" reference image are discarded as non-specific fluorescence. Following immobilization of the primer-released linear amplification product complexes, the bound nucleic acids often are sequenced in parallel by the iterative steps of, a) polymerase extension in the presence of one fluorescently labeled nucleotide, b) detection of fluorescence using appropriate microscopy, TIRM for example, c) removal of fluorescent nucleotide, and d) return to step a with a different fluorescently labeled nucleotide.

In some embodiments, nucleotide sequencing may be by solid phase single nucleotide sequencing methods and processes. Solid phase single nucleotide sequencing methods involve contacting sample nucleic acid and solid support under conditions in which a single molecule of sample nucleic acid hybridizes to a single molecule of a solid support. Such conditions can include providing the solid support molecules and a single molecule of sample nucleic acid in a "microreactor." Such conditions also can include providing a mixture in which the sample nucleic acid molecule can hybridize to solid phase nucleic acid on the solid support. Single nucleotide sequencing methods useful in the embodiments described herein are described in U.S. Provisional Patent Application Ser. No. 61/021,871 filed Jan. 17, 2008.

In certain embodiments, nanopore sequencing detection methods include (a) contacting a nucleic acid for sequencing ("base nucleic acid," e.g., linked probe molecule) with sequence-specific detectors, under conditions in which the detectors specifically hybridize to substantially complementary subsequences of the base nucleic acid; (b) detecting signals from the detectors and (c) determining the sequence of the base nucleic acid according to the signals detected. In certain embodiments, the detectors hybridized to the base nucleic acid are disassociated from the base nucleic acid (e.g., sequentially dissociated) when the detectors interfere with a nanopore structure as the base nucleic acid passes through a pore, and the detectors disassociated from the base sequence are detected. In some embodiments, a detector disassociated from a base nucleic acid emits a detectable signal, and the detector hybridized to the base nucleic acid emits a different detectable signal or no detectable signal. In certain embodiments, nucleotides in a nucleic acid (e.g., linked probe molecule) are substituted with specific nucleotide sequences corresponding to specific nucleotides ("nucleotide representatives"), thereby giving rise to an expanded nucleic acid (e.g., U.S. Pat. No. 6,723,513), and the detectors hybridize to the nucleotide representatives in the expanded nucleic acid, which serves as a base nucleic acid. In such embodiments, nucleotide representatives may be arranged in a binary or higher order arrangement (e.g., Soni and Meller, Clinical Chemistry 53(11): 1996-2001 (2007)). In some embodiments, a nucleic acid is not expanded, does not give rise to an expanded nucleic acid, and directly serves a base nucleic acid (e.g., a linked probe molecule serves as a non-expanded base nucleic acid), and detectors are directly contacted with the base nucleic acid. For example, a first detector may hybridize to a first subsequence and a second detector may hybridize to a second subsequence, where the first detector and second detector each have detectable labels that can be distinguished from one another, and where the signals from the first detector and second detector can be distinguished from one another when the detectors are disassociated from the base nucleic acid. In certain embodiments, detectors include a region that hybridizes to the base nucleic acid (e.g., two regions), which can be about 3 to about 100 nucleotides in length (e.g., about 4, 5, 6, 7, 8, 9, 10, 11, 12, 13, 14, 15, 16, 17, 18, 19, 20, 25, 30, 35, 40, 50, 55, 60, 65, 70, 75, 80, 85, 90, or 95 nucleotides in length). A detector also may include one or more regions of nucleotides that do not hybridize to the base nucleic acid. In some embodiments, a detector is a molecular beacon. A detector often comprises one or more detectable labels independently selected from those described herein. Each detectable label can be detected by any convenient detection process capable of detecting a signal generated by each label (e.g., magnetic, electric, chemical, optical and the like). For example, a CD camera can be used to detect signals from one or more distinguishable quantum dots linked to a detector.

In certain sequence analysis embodiments, reads may be used to construct a larger nucleotide sequence, which can be facilitated by identifying overlapping sequences in different reads and by using identification sequences in the reads. Such sequence analysis methods and software for constructing larger sequences from reads are known to the person of ordinary skill (e.g., Venter et al., Science 291: 1304-1351 (2001)). Specific reads, partial nucleotide sequence constructs, and full nucleotide sequence constructs may be compared between nucleotide sequences within a sample nucleic acid (i.e., internal comparison) or may be compared with a reference sequence (i.e., reference comparison) in certain sequence analysis embodiments. Internal comparisons sometimes are performed in situations where a sample nucleic acid is prepared from multiple samples or from a single sample source that contains sequence variations. Reference comparisons sometimes are performed when a reference nucleotide sequence is known and an objective is to determine whether a sample nucleic acid contains a nucleotide sequence that is substantially similar or the same, or different, than a reference nucleotide sequence. Sequence analysis is facilitated by sequence analysis apparatus and components known to the person of ordinary skill in the art.

Mass spectrometry is a particularly effective method for the detection of a nucleic acids (e.g., PCR amplicon, primer extension product, detector probe cleaved from a target nucleic acid). Presence of a target nucleic acid is verified by comparing the mass of the detected signal with the expected mass of the target nucleic acid. The relative signal strength, e.g., mass peak on a spectra, for a particular target nucleic acid indicates the relative population of the target nucleic acid amongst other nucleic acids, thus enabling calculation of a ratio of target to other nucleic acid or sequence copy number directly from the data. For a review of genotyping methods using Sequenom® standard iPLEX™ assay and MassARRAY® technology, see Jurinke, C., Oeth, P., van den Boom, D., "MALDI-TOF mass spectrometry: a versatile tool for high-performance DNA analysis." Mol. Biotechnol. 26, 147-164 (2004). For a review of detecting and quantifying target nucleic using cleavable detector probes that are cleaved during the amplification process and detected by mass spectrometry, see U.S. patent application Ser. No. 11/950,395, which was filed Dec. 4, 2007, and is hereby incorporated by reference. Such approaches may be adapted to detection of chromosome abnormalities by methods described herein.

In some embodiments, amplified nucleic acid species may be detected by (a) contacting the amplified nucleic acid species (e.g., amplicons) with extension primers (e.g., detection or detector primers), (b) preparing extended extension primers, and (c) determining the relative amount of the one or more mismatch nucleotides (e.g., SNP that exist between paralogous sequences) by analyzing the extended detection primers (e.g., extension primers). In certain embodiments one or more mismatch nucleotides may be analyzed by mass spectrometry. In some embodiments amplification, using methods described herein, may generate between about 1 to about 100 amplicon sets, about 2 to about 80 amplicon sets, about 4 to about 60 amplicon sets, about 6 to about 40 amplicon sets, and about 8 to about 20 amplicon sets (e.g., about 1, 2, 3, 4, 5, 6, 7, 8, 9, 10, 15, 20, 25, 30, 35, 40, 45, 50, 55, 60, 65, 70, 75, 80, 85, 90, 95, or about 100 amplicon sets).

An example using mass spectrometry for detection of amplicon sets is presented herein. Amplicons may be contacted (in solution or on solid phase) with a set of oligonucleotides (the same primers used for amplification or different primers representative of subsequences in the primer or target nucleic acid) under hybridization conditions, where: (1) each oligonucleotide in the set comprises a hybridization sequence capable of specifically hybridizing to one amplicon under the hybridization conditions when the amplicon is present in the solution, (2) each oligonucleotide in the set comprises a distinguishable tag located 5' of the hybridization sequence, (3) a feature of the distinguishable tag of one oligonucleotide detectably differs from the features of distinguishable tags of other oligonucleotides in the set; and (4) each distinguishable tag specifically corresponds to a specific amplicon and thereby specifically corresponds to a specific target nucleic acid. The hybridized amplicon and "detection" primer are subjected to nucleotide synthesis conditions that allow extension of the detection primer by one or more nucleotides (labeled with a detectable entity or moiety, or unlabeled), where one of the one of more nucleotides can be a terminating nucleotide. In some embodiments one or more of the nucleotides added to the primer may comprises a capture agent. In embodiments where hybridization occurred in solution, capture of the primer/amplicon to solid support may be desirable. The detectable moieties or entities can be released from the extended detection primer, and detection of the moiety determines the presence, absence or copy number of the nucleotide sequence of interest. In certain embodiments, the extension may be performed once yielding one extended oligonucleotide. In some embodiments, the extension may be performed multiple times (e.g., under amplification conditions) yielding multiple copies of the extended oligonucleotide. In some embodiments performing the extension multiple times can produce a sufficient number of copies such that interpretation of signals, representing copy number of a particular sequence, can be made with a confidence level of 95% or more (e.g., confidence level of 95% or more, 96% or more, 97% or more, 98% or more, 99% or more, or a confidence level of 99.5% or more).

Methods provided herein allow for high-throughput detection of nucleic acid species in a plurality of nucleic acids (e.g., nucleotide sequence species, amplified nucleic acid species and detectable products generated from the foregoing). Multiplexing refers to the simultaneous detection of more than one nucleic acid species. General methods for performing multiplexed reactions in conjunction with mass spectrometry, are known (see, e.g., U.S. Pat. Nos. 6,043,031, 5,547,835 and International PCT application No. WO 97/37041). Multiplexing provides an advantage that a plurality of nucleic acid species (e.g., some having different sequence variations) can be identified in as few as a single mass spectrum, as compared to having to perform a separate mass spectrometry analysis for each individual target nucleic acid species. Methods provided herein lend themselves to high-throughput, highly-automated processes for analyzing sequence variations with high speed and accuracy, in some embodiments. In some embodiments, methods herein may be multiplexed at high levels in a single reaction.

In certain embodiments, the number of nucleic acid species multiplexed include, without limitation, about 1 to about 500 (e.g., about 1-3, 3-5, 5-7, 7-9, 9-11, 11-13, 13-15, 15-17, 17-19, 19-21, 21-23, 23-25, 25-27, 27-29, 29-31, 31-33, 33-35, 35-37, 37-39, 39-41, 41-43, 43-45, 45-47, 47-49, 49-51, 51-53, 53-55, 55-57, 57-59, 59-61, 61-63, 63-65, 65-67, 67-69, 69-71, 71-73, 73-75, 75-77, 77-79, 79-81, 81-83, 83-85, 85-87, 87-89, 89-91, 91-93, 93-95, 95-97, 97-101, 101-103, 103-105, 105-107, 107-109, 109-111, 111-113, 113-115, 115-117, 117-119, 121-123, 123-125, 125-127, 127-129, 129-131, 131-133, 133-135, 135-137, 137-139, 139-141, 141-143, 143-145, 145-147, 147-149, 149-151, 151-153, 153-155, 155-157, 157-159, 159-161, 161-163, 163-165, 165-167, 167-169, 169-171, 171-173, 173-175, 175-177, 177-179, 179-181, 181-183, 183-185, 185-187, 187-189, 189-191, 191-193, 193-195, 195-197, 197-199, 199-201, 201-203, 203-205, 205-207, 207-209, 209-211, 211-213, 213-215, 215-217, 217-219, 219-221, 221-223, 223-225, 225-227, 227-229, 229-231, 231-233, 233-235, 235-237, 237-239, 239-241, 241-243, 243-245, 245-247, 247-249, 249-251, 251-253, 253-255, 255-257, 257-259, 259-261, 261-263, 263-265, 265-267, 267-269, 269-271, 271-273, 273-275, 275-277, 277-279, 279-281, 281-283, 283-285, 285-287, 287-289, 289-291, 291-293, 293-295, 295-297, 297-299, 299-301, 301-303, 303-305, 305-307, 307-309, 309-311, 311-313, 313-315, 315-317, 317-319, 319-321, 321-323, 323-325, 325-327, 327-329, 329-331, 331-333, 333-335, 335-337, 337-339, 339-341, 341-343, 343-345, 345-347, 347-349, 349-351, 351-353, 353-355, 355-357, 357-359, 359-361, 361-363, 363-365, 365-367, 367-369, 369-371, 371-373, 373-375, 375-377, 377-379, 379-381, 381-383, 383-385, 385-387, 387-389, 389-391, 391-393, 393-395, 395-397, 397-401, 401-403, 403-405, 405-407, 407-409, 409-411, 411-413, 413-415, 415-417, 417-419, 419-421, 421-423, 423-425, 425-427, 427-429, 429-431, 431-433, 433-435, 435-437, 437-439, 439-441, 441-443, 443-445, 445-447, 447-449, 449-451, 451-453, 453-455, 455-457, 457-459, 459-461, 461-463, 463-465, 465-467, 467-469, 469-471, 471-473, 473-475, 475-477, 477-479, 479-481, 481-483, 483-485, 485-487, 487-489, 489-491, 491-493, 493-495, 495-497, 497-501).

Design methods for achieving resolved mass spectra with multiplexed assays can include primer and oligonucleotide design methods and reaction design methods. For primer and oligonucleotide design in multiplexed assays, the same general guidelines for primer design applies for uniplexed reactions, such as avoiding false priming and primer dimers, only more primers are involved for multiplex reactions. For mass spectrometry applications, analyte peaks in the mass spectra for one assay are sufficiently resolved from a product of any assay with which that assay is multiplexed, including pausing peaks and any other by-product peaks. Also, analyte peaks optimally fall within a user-specified mass window, for example, within a range of 5,000-8,500 Da. In some embodiments multiplex analysis may be adapted to mass spectrometric detection of chromosome abnormalities, for example. In certain embodiments multiplex analysis may be adapted to various single nucleotide or nanopore based sequencing methods described herein. Commercially produced micro-reaction chambers or devices or arrays or chips may be used to facilitate multiplex analysis, and are commercially available.

Data Processing and Identifying Presence or Absence of a Chromosome Abnormality

The term "detection" of a chromosome abnormality as used herein refers to identification of an imbalance of chromosomes by processing data arising from detecting sets of amplified nucleic acid species, nucleotide sequence species, or a detectable product generated from the foregoing (collectively "detectable product"). Any suitable detection device and method can be used to distinguish one or more sets of detectable products, as addressed herein. An outcome pertaining to the presence or absence of a chromosome abnormality can be expressed in any suitable form, including, without limitation, probability (e.g., odds ratio, p-value), likelihood, percentage, value over a threshold, or risk factor, associated with the presence of a chromosome abnormality for a subject or sample. An outcome may be provided with one or more of sensitivity, specificity, standard deviation, coefficient of variation (CV) and/or confidence level, or combinations of the foregoing, in certain embodiments.

Detection of a chromosome abnormality based on one or more sets of detectable products may be identified based on one or more calculated variables, including, but not limited to, sensitivity, specificity, standard deviation, coefficient of variation (CV), a threshold, confidence level, score, probability and/or a combination thereof. In some embodiments, (i) the number of sets selected for a diagnostic method, and/or (ii) the particular nucleotide sequence species of each set selected for a diagnostic method, is determined in part or in full according to one or more of such calculated variables.

In certain embodiments, one or more of sensitivity, specificity and/or confidence level are expressed as a percentage. In some embodiments, the percentage, independently for each variable, is greater than about 90% (e.g., about 90, 91, 92, 93, 94, 95, 96, 97, 98 or 99%, or greater than 99% (e.g., about 99.5%, or greater, about 99.9% or greater, about 99.95% or greater, about 99.99% or greater)). Coefficient of variation (CV) in some embodiments is expressed as a percentage, and sometimes the percentage is about 10% or less (e.g., about 10, 9, 8, 7, 6, 5, 4, 3, 2 or 1%, or less than 1% (e.g., about 0.5% or less, about 0.1% or less, about 0.05% or less, about 0.01% or less)). A probability (e.g., that a particular outcome determined by an algorithm is not due to chance) in certain embodiments is expressed as a p-value, and sometimes the p-value is about 0.05 or less (e.g., about 0.05, 0.04, 0.03, 0.02 or 0.01, or less than 0.01 (e.g., about 0.001 or less, about 0.0001 or less, about 0.00001 or less, about 0.000001 or less)).

Scoring or a score refers to calculating the probability that a particular chromosome abnormality is actually present or absent in a subject/sample, in some embodimentse. The value of a score may be used to determine for example the variation, difference, or ratio of amplified nucleic detectable product that may correspond to the actual chromosome abnormality. For example, calculating a positive score from detectable products can lead to an identification of a chromosome abnormality, which is particularly relevant to analysis of single samples.

In certain embodiments, simulated (or simulation) data can aid data processing for example by training an algorithm or testing an algorithm. Simulated data may for instance involve hypothetical various samples of different concentrations of fetal and maternal nucleic acid in serum, plasma and the like. Simulated data may be based on what might be expected from a real population or may be skewed to test an algorithm and/or to assign a correct classification based on a simulated data set. Simulated data also is referred to herein as "virtual" data. Fetal/maternal contributions within a sample can be simulated as a table or array of numbers (for example, as a list of peaks corresponding to the mass signals of cleavage products of a reference biomolecule or amplified nucleic acid sequence), as a mass spectrum, as a pattern of bands on a gel, or as a representation of any technique that measures mass distribution. Simulations can be performed in most instances by a computer program. One possible step in using a simulated data set is to evaluate the confidence of the identified results, i.e. how well the selected positives/negatives match the sample and whether there are additional variations. A common approach is to calculate the probability value (p-value) which estimates the probability of a random sample having better score than the selected one. As p-value calculations can be prohibitive in certain circumstances, an empirical model may be assessed, in which it is assumed that at least one sample matches a reference sample (with or without resolved variations). Alternatively other distributions such as Poisson distribution can be used to describe the probability distribution.

In certain embodiments, an algorithm can assign a confidence value to the true positives, true negatives, false positives and false negatives calculated. The assignment of a likelihood of the occurrence of a chromosome abnormality can also be based on a certain probability model.

Simulated data often is generated in an in silico process. As used herein, the term "in silico" refers to research and experiments performed using a computer. In silico methods include, but are not limited to, molecular modeling studies, karyotyping, genetic calculations, biomolecular docking experiments, and virtual representations of molecular structures and/or processes, such as molecular interactions.

As used herein, a "data processing routine" refers to a process, that can be embodied in software, that determines the biological significance of acquired data (i.e., the ultimate results of an assay). For example, a data processing routine can determine the amount of each nucleotide sequence species based upon the data collected. A data processing routine also may control an instrument and/or a data collection routine based upon results determined. A data processing routine and a data collection routine often are integrated and provide feedback to operate data acquisition by the instrument, and hence provide assay-based judging methods provided herein.

As used herein, software refers to computer readable program instructions that, when executed by a computer, perform computer operations. Typically, software is provided on a program product containing program instructions recorded on a computer readable medium, including, but not limited to, magnetic media including floppy disks, hard disks, and magnetic tape; and optical media including CD-ROM discs, DVD discs, magneto-optical discs, and other such media on which the program instructions can be recorded.

Different methods of predicting abnormality or normality can produce different types of results. For any given prediction, there are four possible types of outcomes: true positive, true negative, false positive, or false negative. The term "true positive" as used herein refers to a subject correctly diagnosed as having a chromosome abnormality. The term "false positive" as used herein refers to a subject wrongly identified as having a chromosome abnormality. The term "true negative" as used herein refers to a subject correctly identified as not having a chromosome abnormality. The term "false negative" as used herein refers to a subject wrongly identified as not having a chromosome abnormality. Two measures of performance for any given method can be calculated based on the ratios of these occurrences: (i) a sensitivity value, the fraction of predicted positives that are correctly identified as being positives (e.g., the fraction of nucleotide sequence sets correctly identified by level comparison detection/determination as indicative of chromosome abnormality, relative to all nucleotide sequence sets identified as such, correctly or incorrectly), thereby reflecting the accuracy of the results in detecting the chromosome abnormality; and (ii) a specificity value, the fraction of predicted negatives correctly identified as being negative (the fraction of nucleotide sequence sets correctly identified by level comparison detection/determination as indicative of chromosomal normality, relative to all nucleotide sequence sets identified as such, correctly or incorrectly), thereby reflecting accuracy of the results in detecting the chromosome abnormality.

The term "sensitivity" as used herein refers to the number of true positives divided by the number of true positives plus the number of false negatives, where sensitivity (sens) may be within the range of $0 \leq sens \leq 1$. Ideally, method embodiments herein have the number of false negatives equaling zero or close to equaling zero, so that no subject is wrongly identified as not having at least one chromosome abnormality when they indeed have at least one chromosome abnormality. Conversely, an assessment often is made of the ability of a prediction algorithm to classify negatives correctly, a complementary measurement to sensitivity. The term "specificity" as used herein refers to the number of true negatives divided by the number of true negatives plus the number of false positives, where sensitivity (spec) may be within the range of $0 \leq spec \leq 1$. Ideally, methods embodiments herein have the number of false positives equaling zero or close to equaling zero, so that no subject wrongly identified as having at least one chromosome abnormality when they do not have the chromosome abnormality being assessed. Hence, a method that has sensitivity and specificity equaling one, or 100%, sometimes is selected.

One or more prediction algorithms may be used to determine significance or give meaning to the detection data collected under variable conditions that may be weighed independently of or dependently on each other. The term "variable" as used herein refers to a factor, quantity, or function of an algorithm that has a value or set of values. For example, a variable may be the design of a set of amplified nucleic acid species, the number of sets of amplified nucleic acid species, percent fetal genetic contribution tested, percent maternal genetic contribution tested, type of chromosome abnormality assayed, type of sex-linked abnormalities assayed, the age of the mother and the like. The term "independent" as used herein refers to not being influenced or not being controlled by another. The term "dependent" as used herein refers to being influenced or controlled by another. For example, a particular chromosome and a trisomy event occurring for that particular chromosome that results in a viable being are variables that are dependent upon each other.

One of skill in the art may use any type of method or prediction algorithm to give significance to the data of the present technology within an acceptable sensitivity and/or specificity. For example, prediction algorithms such as Chi-squared test, z-test, t-test, ANOVA (analysis of variance), regression analysis, neural nets, fuzzy logic, Hidden Markov Models, multiple model state estimation, and the like may be used. One or more methods or prediction algorithms may be determined to give significance to the data having different independent and/or dependent variables of the present technology. And one or more methods or prediction algorithms may be determined not to give significance to the data having different independent and/or dependent variables of the present technology. One may design or change parameters of the different variables of methods described herein based on results of one or more prediction algorithms (e.g., number of sets analyzed, types of nucleotide species in each set). For example, applying the Chi-squared test to detection data may suggest that specific ranges of maternal age are correlated to a higher likelihood of having an offspring with a specific chromosome abnormality, hence the variable of maternal age may be weighed differently verses being weighed the same as other variables.

In certain embodiments, several algorithms may be chosen to be tested. These algorithms are then can be trained with raw data. For each new raw data sample, the trained algorithms will assign a classification to that sample (i.e. trisomy or normal). Based on the classifications of the new raw data samples, the trained algorithms' performance may be assessed based on sensitivity and specificity. Finally, an algorithm with the highest sensitivity and/or specificity or combination thereof may be identified.

In some embodiments a ratio of nucleotide sequence species in a set is expected to be about 1.0:1.0, which can indicate the nucleotide sequence species in the set are in different chromosomes present in the same number in the subject. When nucleotide sequence species in a set are on chromosomes present in different numbers in the subject (for example, in trisomy 21) the set ratio which is detected is lower or higher than about 1.0:1.0. Where extracellular nucleic acid is utilized as template nucleic acid, the measured set ratio often is not 1.0:1.0 (euploid) or 1.0:1.5 (e.g., trisomy 21), due to a variety of factors. Although, the expected measured ratio can vary, so long as such variation is substantially reproducible and detectable. For example, a particular set might provide a reproducible measured ratio (for example of peaks in a mass spectrograph) of 1.0:1.2 in a euploid measurement. The aneuploid measurement for such a set might then be, for example, 1.0:1.3. The, for example, 1.3 versus 1.2 measurement is the result of measuring the fetal nucleic acid against a background of maternal nucleic acid, which decreases the signal that would otherwise be provided by a "pure" fetal sample, such as from amniotic fluid or from a fetal cell.

As noted above, algorithms, software, processors and/or machines, for example, can be utilized to (i) process detection data pertaining to nucleotide sequence species and/or amplified nucleic acid species of sets, and/or (ii) identify the presence or absence of a chromosome abnormality.

Also provided are methods for identifying the presence or absence of a chromosome abnormality in a subject that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species from two or more sets; and (e) organizing, by the data display organization model in response to being called by the logic processing module, a data display indicating the presence or absence of a chromosome abnormality in the subject.

Provided also are multiplex methods for identifying the presence or absence of an abnormality of a target chromosome in a subject that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; c) receiving, by the logic processing module, the signal information; (d) detecting the presence or absence of a decrease or increase of the target chromosome from the amount of each amplified nucleic acid species in the sets; (e) calling the presence or absence of a chromosomal abnormality by the logic processing module, whereby the presence or absence of the chromosome abnormality is identified based on a decrease or increase of the target chromosome relative to the one or more reference chromosomes based on the amount of the amplified nucleic acid species from two or more sets; and (e) organizing, by the data display organization model in response to being called by the logic processing module, a data display indicating the presence or absence of a chromosome abnormality in the subject.

Also provided are methods for identifying the presence or absence of a chromosome abnormality in a subject that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species; and (e) organizing, by the data display organization model in response to being called by the logic processing module, a data display indicating the presence or absence of a chromosome abnormality in the subject.

Provided also are methods for identifying the presence or absence of a chromosome abnormality in a subject, that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species from two or more sets; and (e) organizing, by the data display organization model in response to being called by the logic processing module, a data display indicating the presence or absence of a chromosome abnormality in the subject.

Also provided are methods for identifying the presence or absence of a chromosome abnormality in a subject, which comprise obtaining a plurality of sets of amplified nucleic acid species prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; parsing a configuration file into definition data that specifies: the amount of each amplified nucleic acid species; receiving, by the logic processing module, the definition data; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Provided also are methods for identifying the presence or absence of a chromosome abnormality in a subject, comprising preparing a plurality of sets of amplified nucleic acid species by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; parsing a configuration file into definition data that specifies: the amount of each amplified nucleic acid species; receiving, by the logic processing module, the definition data; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Provided also are methods for identifying the presence or absence of a chromosome abnormality in a subject, which comprise providing signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; receiving, by the logic processing module, the signal information; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Provided also are multiplex methods for identifying the presence or absence of an abnormality of a target chromosome in a subject that comprises providing signal information indicating the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; receiving, by the logic processing module, the signal information; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Also provided are methods for identifying the presence or absence of a chromosome abnormality in a subject that comprises providing signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; receiving, by the logic processing module, the signal information; calling the presence or absence of a chromosomal abnormality by the logic processing module, whereby the presence or absence of the chromosome abnormality is identified based on the amount of the amplified nucleic acid species; and organizing, by the data display organization model in response to being called by the logic processing module, a data display indicating the presence or absence of a chromosome abnormality in the subject.

Also provided are methods for identifying the presence or absence of a chromosome abnormality in a subject that comprises providing signal information indicating the amount of each amplified nucleic acid species in each of a plurality of sets of amplified nucleic acid species, where the plurality of sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; providing a system, where the system comprises distinct software modules, and where the distinct software modules comprise a signal detection module, a logic processing module, and a data display organization module; receiving, by the logic processing module, the signal information; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Also provided are methods for identifying the presence or absence of a chromosome abnormality in a subject, which comprise providing a system, where the system comprises distinct software modules, and where the distinct software modules comprise a signal detection module, a logic processing module, and a data display organization module; (please have someone review which modules are needed, or if we need more steps/description) receiving, by the logic processing module, signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Provided also are multiplex methods for identifying the presence or absence of an abnormality of a target chromosome in a subject that comprises providing a system, where the system comprises distinct software modules, and where the distinct software modules comprise a signal detection module, a logic processing module, and a data display organization module; receiving, by the logic processing module, signal information indicating the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

Also provided are methods for identifying the presence or absence of a chromosome abnormality in a subject that comprises providing a system, where the system comprises distinct software modules, and where the distinct software modules comprise a signal detection module, a logic processing module, and a data display organization module; receiving, by the logic processing module, signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; calling the presence or absence of a chromosomal abnormality by the logic processing module, whereby the presence or absence of the chromosome abnormality is identified based on the amount of the amplified nucleic acid species; and organizing, by the data display organization model in response to being called by the logic processing module, a data display indicating the presence or absence of a chromosome abnormality in the subject.

Also provided are methods for identifying the presence or absence of a chromosome abnormality in a subject that comprises providing a system, where the system comprises distinct software modules, and where the distinct software modules comprise a signal detection module, a logic processing module, and a data display organization module; receiving, by the logic processing module, signal information indicating the amount of each amplified nucleic acid species in each of a plurality of sets of amplified nucleic acid species, where the plurality of sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; calling the presence or absence of a chromosomal abnormality by the logic processing module, whereby the presence or absence of the chromosome abnormality is identified based on the amount of the amplified nucleic acid species from two or more sets; and organizing, by the data display organization model in response to being called by the logic processing module, a data display indicating the presence or absence of a chromosome abnormality in the subject.

By "providing signal information" is meant any manner of providing the information, including, for example, computer communication means from a local, or remote site, human data entry, or any other method of transmitting signal information. The signal information may generated in one location and provided to another location.

By "obtaining" or "receiving" signal information is meant receiving the signal information by computer communication means from a local, or remote site, human data entry, or any other method of receiving signal information. The signal information may be generated in the same location at which it is received, or it may be generated in a different location and transmitted to the receiving location.

By "indicating" or "representing" the amount is meant that the signal information is related to, or correlates with, the amount of, for example, amplified nucleic acid species. The information may be, for example, the calculated data associated with the amount of amplified nucleic acid as obtained, for example, after converting raw data obtained by mass spectrometry of the amplified nucleic acid. The signal information may be, for example, the raw data obtained from analysis of the amplified nucleic acid by methods such as, for example, mass spectrometry.

Also provided are computer program products, such as, for example, a computer program products comprising a computer usable medium having a computer readable program code embodied therein, the computer readable program code adapted to be executed to implement a method for identifying the presence or absence of a chromosome abnormality in a subject, the method comprising: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species from two or more sets; and (e) organizing, by the data display organization model in response to being called by the logic processing module, a data display indicating the presence or absence of a chromosome abnormality in the subject.

Provided also are computer program products comprising a computer usable medium having a computer readable program code embodied therein, the computer readable program code adapted to be executed to implement a method for identifying the presence or absence of a chromosome abnormality in a subject, the method comprising: multiplex methods for identifying the presence or absence of an abnormality of a target chromosome in a subject that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; c) receiving, by the logic processing module, the signal information; (d) detecting the presence or absence of a decrease or increase of the target chromosome from the amount of each amplified nucleic acid species in the sets; (e) calling the presence or absence of a chromosomal abnormality by the logic processing module, whereby the presence or absence of the chromosome abnormality is identified based on a decrease or increase of the target chromosome relative to the one or more reference chromosomes based on the amount of the amplified nucleic acid species from two or more sets; and (e) organizing, by the data display organization model in response to being called by the logic processing module, a data display indicating the presence or absence of a chromosome abnormality in the subject.

Also provided are computer program products comprising a computer usable medium having a computer readable program code embodied therein, the computer readable program code adapted to be executed to implement methods for identifying the presence or absence of a chromosome abnormality in a subject that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species; and (e) organizing, by the data display organization model in response to being called by the logic processing module, a data display indicating the presence or absence of a chromosome abnormality in the subject.

Provided also are computer program products comprising a computer usable medium having a computer readable program code embodied therein, the computer readable program code adapted to be executed to implement methods for identifying the presence or absence of a chromosome abnormality in a subject, that comprise: (a) providing a system, where the system comprises distinct software modules, and where the distinct software modules comprise a signal detection module, a logic processing module, and a data display organization module; (b) detecting signal information derived from determining the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (c) receiving, by the logic processing module, the signal information; (d) calling the presence or absence of a chromosomal abnormality by the logic processing module, whereby the presence or absence of the chromosome abnormality is identified based on the amount of the amplified nucleic acid species from two or more sets; and (e) organizing, by the data display organization model in response to being called by the logic processing module, a data display indicating the presence or absence of a chromosome abnormality in the subject.

Provided also is a computer program product, comprising a computer usable medium having a computer readable program code embodied therein, said computer readable program code adapted to be executed to implement a method for identifying the presence or absence of a chromosome abnormality in a subject, said method comprising: providing a system, where the system comprises distinct software modules, and where the distinct software modules comprise a signal detection module, a logic processing module, and a data display organization module; parsing a configuration file into definition data that specifies: the amount of each amplified nucleic acid species in each set receiving, by the logic processing module, the definition data; calling the presence or absence of a chromosomal abnormality by the logic processing module; and organizing, by the data display organization model in response to being called by the logic processing module, a data display indicating the presence or absence of a chromosome abnormality in the subject.

Provided also is a computer program product, comprising a computer usable medium having a computer readable program code embodied therein, said computer readable program code adapted to be executed to implement a method for identifying the presence or absence of a chromosome abnormality in a subject, the method comprising providing a system, where the system comprises distinct software modules, and where the distinct software modules comprise a signal detection module, a logic processing module, and a data display organization module; receiving signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; calling the presence or absence of a chromosomal abnormality by the logic processing module; and organizing, by the data display organization model in response to being called by the logic processing module, a data display indicating the presence or absence of a chromosome abnormality in the subject.

Provided also are computer program products comprising a computer usable medium having a computer readable program code embodied therein, the computer readable program code adapted to be executed to implement a method for identifying the presence or absence of a chromosome abnormality in a subject, the method comprising: multiplex methods for identifying the presence or absence of an abnormality of a target chromosome in a subject that comprise: (a) providing a system, where the system comprises distinct software modules, and where the distinct software modules comprise a signal detection module, a logic processing module, and a data display organization module; (b) receiving signal information indicating the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; calling the presence or absence of a chromosomal abnormality by the logic processing module; and organizing, by the data display organization model in response to being called by the logic processing module, a data display indicating the presence or absence of a chromosome abnormality in the subject.

Also provided are computer program products comprising a computer usable medium having a computer readable program code embodied therein, the computer readable program code adapted to be executed to implement methods for identifying the presence or absence of a chromosome abnormality in a subject that comprise: (a) providing a system, where the system comprises distinct software modules, and where the distinct software modules comprise a signal detection module, a logic processing module, and a data display organization module; (b) receiving signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; calling the presence or absence of a chromosomal abnormality by the logic processing module; and organizing, by the data display organization model in response to being called by the logic processing module, a data display indicating the presence or absence of a chromosome abnormality in the subject.

Provided also are computer program products comprising a computer usable medium having a computer readable program code embodied therein, the computer readable program code adapted to be executed to implement methods for identifying the presence or absence of a chromosome abnormality in a subject, that comprise: (a) providing a system, where the system comprises distinct software modules, and where the distinct software modules comprise a signal detection module, a logic processing module, and a data display organization module; (b) receiving signal information indicating the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and calling the presence or absence of a chromosomal abnormality by the logic processing module; and organizing, by the data display organization model in response to being called by the logic processing module, a data display indicating the presence or absence of a chromosome abnormality in the subject.

Provided also are methods for identifying the presence or absence of a chromosome abnormality in a subject that comprise: (a) detecting signal information, where the signal information represents the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (b) transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and (c) displaying the identification data.

Signal information may be, for example, mass spectrometry data obtained from mass spectrometry of amplified nucleic acid. The mass spectrometry data may be raw data, such as, for example, a set of numbers, or, for example, a two dimensional display of the mass spectrum. The signal information may be converted or transformed to any form of data that may be provided to, or received by, a computer system. The signal information may also, for example, be converted, or transformed to identification data or information representing the chromosome number in cells. Where the chromosome number is greater or less than in euploid cells, the presence of a chromosome abnormality may be identified.

Also provided are methods for identifying the presence or absence of a chromosome abnormality in a subject that comprise: (a) detecting signal information, where the signal information represents the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (b) transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and (c) displaying the identification data.

Provided also are multiplex methods for identifying the presence or absence of an abnormality of a target chromosome in a subject that comprise: (a) detecting signal information, where the signal information represents the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; (b) detecting the presence or absence of a decrease or increase of the target chromosome from the amount of each amplified nucleic acid species in the sets; (c) based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and (c) displaying the identification data.

Also provided are methods for identifying the presence or absence of a chromosome abnormality in a subject that comprise: (a) detecting signal information, where the signal information represents the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (b) transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and (c) displaying the identification data.

Provided also are methods for identifying the presence or absence of a chromosome abnormality in a subject, that comprise: (a) detecting signal information, where the signal information represents the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; (b) transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and (c) displaying the identification data.

Also provided are methods for identifying the presence or absence of a chromosome abnormality in a subject, comprising preparing a plurality of sets of amplified nucleic acid species by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and obtaining a data set of values representing the amount of each amplified nucleic acid species in each set; transforming the data set of values representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identified data.

Also provided are methods for identifying the presence or absence of a chromosome abnormality in a subject, which comprise providing signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information indicating the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

Provided also are multiplex methods for identifying the presence or absence of an abnormality of a target chromosome in a subject that comprise: providing signal information indicating the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

Also provided are methods for identifying the presence or absence of a chromosome abnormality in a subject that comprise: providing signal information indicating amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and displaying the identification data.

Provided also are methods for identifying the presence or absence of a chromosome abnormality in a subject, that comprise: providing signal information indicating detecting signal information, where the signal information represents the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

Provided also are methods for identifying the presence or absence of a chromosome abnormality in a subject, which comprise receiving signal information indicating the amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information indicating the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

Provided also are multiplex methods for identifying the presence or absence of an abnormality of a target chromosome in a subject that comprise: receiving signal information indicating the amount of each amplified nucleic acid species in each of three or more sets of amplified nucleic acid species, where the three or more sets are prepared by amplifying three or more nucleotide sequence sets from extracellular nucleic acid template of a subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

Also provided are methods for identifying the presence or absence of a chromosome abnormality in a subject that comprise: receiving signal information indicating amount of each amplified nucleic acid species in each of a plurality of sets of amplified nucleic acid species, where the plurality of sets of amplified nucleic acid species are prepared by amplifying a plurality of nucleotide sequence sets from extracellular nucleic acid template of a subject, where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and displaying the identification data.

Provided also are methods for identifying the presence or absence of a chromosome abnormality in a subject, that comprise: receiving signal information indicating detecting signal information, where the signal information represents the amount of each amplified nucleic acid species in each of a plurality of sets of amplified nucleic acid species, where the sets of amplified nucleic acid species are prepared by amplifying nucleotide sequences from extracellular nucleic acid template of a subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and displaying the identification data.

For purposes of these, and similar embodiments, the term "signal information" indicates information readable by any electronic media, including, for example, computers that represent data derived using the present methods. For example, "signal information" can represent the amount of amplified nucleic acid species in a set of amplified nucleic acid species. Or, for example, it can represent the presence or absence of a decrease or an increase of one or more amplified nucleic acid species. Signal information, such as in these examples, that represents physical substances may be transformed into identification data, such as a visual display, that represents other physical substances, such as, for example, a chromosome abnormality. Identification data may be displayed in any appropriate manner, including, but not limited to, in a computer visual display, by encoding the identification data into computer readable media that may, for example, be transferred to another electronic device, or by creating a hard copy of the display, such as a print out of information. The information may also be displayed by auditory signal or any other means of information communication.

In some embodiments, the signal information may be detection data obtained using methods to detect the amplified nucleic acid species of the present technology, such as, for example, without limitation, data obtained from primer extension, sequencing, digital polymerase chain reaction (PCR), quantitative PCR (Q-PCR) and mass spectrometry. In some embodiments, the amplified nucleic acid species are detected by: (i) contacting the amplified nucleic acid species with extension primers, (ii) preparing extended extension primers, and (iii) determining the relative amount of the one or more mismatch nucleotides by analyzing the extended extension primers. The one or more mismatch nucleotides are analyzed by mass spectrometry in some embodiments. Where the signal information is detection data, the amount of the amplified nucleic acid species in a set of amplified nucleic acid species, or the presence or absence of a decrease or an increase of one or more amplified nucleic acid species may be determined by the logic processing module.

Once the signal information is detected, it may be forwarded to the logic processing module. The logic processing module may "call" or "identify" the presence or absence of a chromosome abnormality by analyzing the amount of amplified nucleic acid in two, or three, sets. Or, the chromosome abnormality may be called or identified by the logic processing module based on a decrease or increase of the target chromosome relative to the one or more reference chromosomes based on the amount of the amplified nucleic acid species from two or more sets.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets; and transmitting the presence or absence of the chromosomal abnormality to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by a multiplex method by amplifying three or more nucleotide sequence sets from extracellular nucleic acid template from placenta-expressed nucleic acid in the blood of the pregnant female subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; transmitting the presence or absence of the chromosomal abnormality to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and transmitting the presence or absence of the chromosomal abnormality to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and transmitting the presence or absence of the chromosomal abnormality to the pregnant female subject.

Also provided are methods for transmitting prenatal genetic information to a human pregnant female subject, comprising identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets; and transmitting prenatal genetic information representing the chromosome number in cells in the fetus to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by a multiplex method by amplifying three or more nucleotide sequence sets from extracellular nucleic acid template from placenta-expressed nucleic acid in the blood of the pregnant female subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; transmitting prenatal genetic information representing the chromosome number in cells in the fetus to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and transmitting prenatal genetic information representing the chromosome number in cells in the fetus to the pregnant female subject.

Provided also are methods for transmitting prenatal genetic information to a human pregnant female subject, which comprises identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and transmitting prenatal genetic information representing the chromosome number in cells in the fetus to the pregnant female subject.

The term "identifying the presence or absence of a chromosomal abnormality" as used herein refers to any method for obtaining such information, including, without limitation, obtaining the information from a laboratory file. A laboratory file can be generated by a laboratory that carried out an assay to determine the presence or absence of the chromosomal abnormality. The laboratory may be in the same location or different location (e.g., in another country) as the personnel identifying the presence or absence of the chromosomal abnormality from the laboratory file. For example, the laboratory file can be generated in one location and transmitted to another location in which the information therein will be transmitted to the pregnant female subject. The laboratory file may be in tangible form or electronic form (e.g., computer readable form), in certain embodiments.

The term "transmitting the presence or absence of the chromosomal abnormality to the pregnant female subject" as used herein refers to communicating the information to the female subject, or family member, guardian or designee thereof, in a suitable medium, including, without limitation, in verbal, document, or file form.

Also provided are methods for providing to a human pregnant female subject a medical prescription based on prenatal genetic information, which comprise identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets; and providing a medical prescription based on the presence or absence of the chromosomal abnormality to the pregnant female subject.

Also provided are methods for providing to a human pregnant female subject a medical prescription based on prenatal genetic information, which comprise identifying the presence or absence of a chromosomal abnormality in the fetus of the pregnant female subject, where the presence or absence of the chromosomal abnormality has been determined by a multiplex method by amplifying three or more nucleotide sequence sets from extracellular nucleic acid template from placenta-expressed nucleic acid in the blood of the pregnant female subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; providing a medical prescription based on the presence or absence of the chromosomal abnormality to the pregnant female subject.

Also provided are methods for providing to a human pregnant female subject a medical prescription based on prenatal genetic information, which comprise identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and providing a medical prescription based on the presence or absence of the chromosomal abnormality to the pregnant female subject.

Also provided are methods for providing to a human pregnant female subject a medical prescription based on prenatal genetic information, which comprise identifying the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and providing a medical prescription based on the presence or absence of the chromosomal abnormality to the pregnant female subject.

The term "providing a medical prescription based on prenatal genetic information" refers to communicating the prescription to the female subject, or family member, guardian or designee thereof, in a suitable medium, including, without limitation, in verbal, document or file form.

Also provided are methods for providing to a human pregnant female subject a medical prescription based on prenatal genetic information, which comprise reporting to a pregnant female subject the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets; and providing a medical prescription based on the presence or absence of the chromosome abnormality to the pregnant female subject.

Also included herein are methods for providing to a human pregnant female subject a medical prescription based on prenatal genetic information, which comprise reporting to a pregnant female subject the presence or absence of a chromosomal abnormality in the fetus of the pregnant female subject, where the presence or absence of the chromosomal abnormality has been determined by amplifying three or more nucleotide sequence sets from extracellular nucleic acid template from placenta-expressed nucleic acid in the blood of the pregnant female subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; providing a medical prescription based on the presence or absence of the chromosomal abnormality to the pregnant female subject.

Also provided are methods for providing to a human pregnant female subject a medical prescription based on prenatal genetic information, which comprise reporting to a pregnant female subject the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species; and providing a medical prescription based on the presence or absence of the chromosomal abnormality to the pregnant female subject.

Also provided are methods for providing to a human pregnant female subject a medical prescription based on prenatal genetic information, which comprise reporting to a pregnant female subject the presence or absence of a chromosomal abnormality in the fetus of the pregnant female subject, where the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets; and providing a medical prescription based on the presence or absence of the chromosomal abnormality to the pregnant female subject.

The medical prescription may be for any course of action determined by, for example, a medical professional upon reviewing the prenatal genetic information. For example, the prescription may be for the pregnant female subject to undergo an amniocentesis procedure. Or, in another example, the medical prescription may be for the pregnant female subject to undergo another genetic test. In yet another example, the medical prescription may be medical advice to not undergo further genetic testing.

Also provided are files, such as, for example, a file comprising the presence or absence of a chromosome abnormality in the fetus of a pregnant female subject, where the presence or absence of the chromosome abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, where: (i) the extracellular nucleic acid template is heterogeneous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets.

Also provided are files, such as, for example, a file comprising the presence or absence of a chromosome abnormality in the fetus of a pregnant female subject, where the presence or absence of the chromosome abnormality has been determined by amplifying three or more nucleotide sequence sets from extracellular nucleic acid template from placenta-expressed nucleic acid in the blood of the pregnant female subject, where: (i) the extracellular nucleic acid template is heterogeneous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; detecting the presence or absence of a decrease or increase of the target chromosome from the amount of each amplified nucleic acid species in the sets; based on the presence or absence of a decrease or increase of the target chromosome from the amount of each amplified nucleic acid species in the sets, transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets.

Also provided are files, such as, for example, a file comprising the presence or absence of a chromosome abnormality in the fetus of a pregnant female subject, where the presence or absence of the chromosome abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject where: (i) the extracellular nucleic acid template is heterogeneous, (ii) each nucleotide sequence in a set is present on three or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species.

Also provided are files, such as, for example, a file comprising the presence or absence of a chromosome abnormality in the fetus of a pregnant female subject, where the presence or absence of the chromosome abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, where: (i) the extracellular nucleic acid template is heterogeneous, (ii) each nucleotide sequence in a set is present on chromosome 21, chromosome 18 and chromosome 13, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; transforming the signal information representing the amount of each amplified nucleic acid species in each set into identification data, where the identification data represents the presence or absence of the chromosome abnormality, whereby the presence or absence of the chromosome abnormality is identified based on the amount of the amplified nucleic acid species from two or more sets.

The file may be, for example, but not limited to, a computer readable file, a paper file, or a medical record file.

Computer program products include, for example, any electronic storage medium that may be used to provide instructions to a computer, such as, for example, a removable storage device, CD-ROMS, a hard disk installed in hard disk drive, signals, magnetic tape, DVDs, optical disks, flash drives, RAM or floppy disk, and the like.

The systems discussed herein may further comprise general components of computer systems, such as, for example, network servers, laptop systems, desktop systems, handheld systems, personal digital assistants, computing kiosks, and the like. The computer system may comprise one or more input means such as a keyboard, touch screen, mouse, voice recognition or other means to allow the user to enter data into the system. The system may further comprise one or more output means such as a CRT or LCD display screen, speaker, FAX machine, impact printer, inkjet printer, black and white or color laser printer or other means of providing visual, auditory or hardcopy output of information. In certain embodiments, a system includes one or more machines. The input and output means may be connected to a central processing unit which may comprise among other components, a microprocessor for executing program instructions and memory for storing program code and data. In some embodiments the methods may be implemented as a single user system located in a single geographical site. In other embodiments methods may be implemented as a multi-user system. In the case of a multi-user implementation, multiple central processing units may be connected by means of a network. The network may be local, encompassing a single department in one portion of a building, an entire building, span multiple buildings, span a region, span an entire country or be worldwide. The network may be private, being owned and controlled by the provider or it may be implemented as an internet based service where the user accesses a web page to enter and retrieve information.

The various software modules associated with the implementation of the present products and methods can be suitably loaded into the a computer system as desired, or the software code can be stored on a computer-readable medium such as a floppy disk, magnetic tape, or an optical disk, or the like. In an online implementation, a server and web site maintained by an organization can be configured to provide software downloads to remote users. As used herein, "module," including grammatical variations thereof, means, a self-contained functional unit which is used with a larger system. For example, a software module is a part of a program that performs a particular task.

The present methods may be implemented using hardware, software or a combination thereof and may be implemented in a computer system or other processing system. An example computer system may include one or more processors. A processor can be connected to a communication bus. The computer system may include a main memory, often random access memory (RAM), and can also include a secondary memory. The secondary memory can include, for example, a hard disk drive and/or a removable storage drive, representing a floppy disk drive, a magnetic tape drive, an optical disk drive, memory card etc. The removable storage drive reads from and/or writes to a removable storage unit in a well-known manner. A removable storage unit includes, but is not limited to, a floppy disk, magnetic tape, optical disk, etc. which is read by and written to by, for example, a removable storage drive. As will be appreciated, the removable storage unit includes a computer usable storage medium having stored therein computer software and/or data.

In alternative embodiments, secondary memory may include other similar means for allowing computer programs or other instructions to be loaded into a computer system. Such means can include, for example, a removable storage unit and an interface device. Examples of such can include a program cartridge and cartridge interface (such as that found in video game devices), a removable memory chip (such as an EPROM, or PROM) and associated socket, and other removable storage units and interfaces which allow software and data to be transferred from the removable storage unit to a computer system.

The computer system may also include a communications interface. A communications interface allows software and data to be transferred between the computer system and external devices. Examples of communications interface can include a modem, a network interface (such as an Ethernet card), a communications port, a PCMCIA slot and card, etc. Software and data transferred via communications interface are in the form of signals, which can be electronic, electromagnetic, optical or other signals capable of being received by communications interface. These signals are provided to communications interface via a channel. This channel carries signals and can be implemented using wire or cable, fiber optics, a phone line, a cellular phone link, an RF link and other communications channels. Thus, in one example, a communications interface may be used to receive signal information to be detected by the signal detection module.

In a related aspect, the signal information may be input by a variety of means, including but not limited to, manual input devices or direct data entry devices (DDEs). For example, manual devices may include, keyboards, concept keyboards, touch sensitive screens, light pens, mouse, tracker balls, joysticks, graphic tablets, scanners, digital cameras, video digitizers and voice recognition devices. DDEs may include, for example, bar code readers, magnetic strip codes, smart cards, magnetic ink character recognition, optical character recognition, optical mark recognition, and turnaround documents. In one embodiment, an output from a gene or chip reader my serve as an input signal.

Combination Diagnostic Assays

Results from nucleotide species assays described in sections above can be combined with results from one or more other assays, referred to herein as "secondary assays," and results from the combination of the assays can be utilized to identify the presence or absence of aneuploidy. Results from a non-invasive nucleotide species assay described above may be combined with results from one or more other non-invasive assays and/or one or more invasive assays. In certain embodiments, results from a secondary assay are combined with results from a nucleotide species assay described above when a sample contains an amount of fetal nucleic acid below a certain threshold amount. A threshold amount of fetal nucleic acid sometimes is about 15% in certain embodiments.

In some embodiments, a nucleotide species assay described in sections above may be combined with a secondary nucleic acid-based allele counting assay. Allele-based methods for diagnosing, monitoring, or predicting chromosomal abnormalities rely on determining the ratio of the alleles found in maternal sample comprising free, fetal nucleic acid. The ratio of alleles refers to the ratio of the population of one allele and the population of the other allele in a biological sample. In some cases, it is possible that in trisomies a fetus may be tri-allelic for a particular locus, and these tri-allelic events may be detected to diagnose aneuploidy. In some embodiments, a secondary assay detects a paternal allele, and in certain embodiments, the mother is homozygous at the polymorphic site and the fetus is heterozygous at the polymorphic site detected in the secondary assay. In a related embodiment, the mother is first genotyped (for example, using peripheral blood mononuclear cells (PBMC) from a maternal whole blood sample) to determine the non-target allele that will be targeted by the cleavage agent in a secondary assay.

In certain embodiments, a nucleotide species assay described above may be combined with a secondary RNA-based diagnostic method. RNA-based methods for diagnosing, monitoring, or predicting chromosomal abnormalities often rely on the use of pregnancy-specificity of fetal-expressed transcripts to develop a method which allows the genetic determination of fetal chromosomal aneuploidy and thus the establishment of its diagnosis non-invasively. In one embodiment, the fetal-expressed transcripts are those expressed in the placenta. Specifically, a secondary assay may detect one or more single nucleotide polymorphisms (SNPs) from RNA transcripts with tissue-specific expression patterns that are encoded by genes on the aneuploid chromosome. Other polymorphisms also may be detected by a secondary assay, such as an insertion/deletion polymorphism and a simple tandem repeat polymorphism, for example. The status of the locus may be determined through the assessment of the ratio between informative SNPs on the RNA transcribed from the genetic loci of interest in a secondary assay. Genetic loci of interest may include, but are not limited to, COL6A1, SOD1, COL6A2, ATP5O, BTG3, ADAMTS1, BACE2, ITSN1, APP, ATP5J, DSCR5, PLAC4, LOC90625, RPL17, SERPINB2 or COL4A2, in a secondary assay.

In some embodiments, a nucleotide species assay described in sections above may be combined with a secondary methylation-based assay. Methylation-based tests sometimes are directed to detecting a fetal-specific DNA methylation marker for detection in maternal plasma. It has been demonstrated that fetal and maternal DNA can be distinguished by differences in methylation status (see U.S. Pat. No. 6,927,028, issued Aug. 9, 2005). Methylation is an epigenetic phenomenon, which refers to processes that alter a phenotype without involving changes in the DNA sequence. Poon et al. further showed that epigenetic markers can be used to detect fetal-derived maternally-inherited DNA sequence from maternal plasma (Clin. Chem. 48:35-41, 2002). Epigenetic markers may be used for non-invasive prenatal diagnosis by determining the methylation status of at least a portion of a differentially methylated gene in a blood sample, where the portion of the differentially methylated gene from the fetus and the portion from the pregnant female are differentially methylated, thereby distinguishing the gene from the female and the gene from the fetus in the blood sample; determining the level of the fetal gene; and comparing the level of the fetal gene with a standard control. In some cases, an increase from the standard control indicates the presence or progression of a pregnancy-associated disorder. In other cases, a decrease from the standard control indicates the presence or progression of a pregnancy-associated disorder.

In certain embodiments, a nucleotide species assay described in sections above may be combined with another secondary molecular assay. Other molecular methods for the diagnosis of aneuploidies are also known (Hulten et al., 2003, Reproduction, 126(3):279-97; Armour et al., 2002, Human Mutation 20(5):325-37; Eiben and Glaubitz, J Histochem Cytochem. 2005 March; 53(3):281-3; and Nicolaides et al., J Matern Fetal Neonatal Med. 2002 July; 12(1):9-18)). Alternative molecular methods include PCR based methods such as QF-PCR (Verma et al., 1998, Lancet 352(9121):9-12; Pertl et al., 1994, Lancet 343(8907):1197-8; Mann et al., 2001, Lancet 358(9287):1057-61; Adinolfi et al., 1997, Prenatal Diagnosis 17(13):1299-311), multiple amplifiable probe hybridization (MAPH) (Armour et al., 2000, Nucleic Acids Res 28(2):605-9), multiplex probe ligation assay (MPLA) (Slater et al., 2003, J Med Genet 40(12)907-12; Schouten et al., 2002 30(12:e57), all of which are hereby incorporated by reference. Non PCR-based technologies such as comparative genome hybridization (CGH) offer another approach to aneuploidy detection (Veltman et al., 2002, Am J Hum Genet 70(5):1269-76; Snijders et al., 2001 Nat Genet 29(3):263-4).

In some embodiments, a nucleotide species assay described in sections above may be combined with a secondary non-nucleic acid-based chromosome test. Non-limiting examples of non-nucleic acid-based tests include, but are not limited to, invasive amniocentesis or chorionic villus sampling-based test, a maternal age-based test, a biomarker screening test, and an ultrasonography-based test. A biomarker screening test may be performed where nucleic acid (e.g., fetal or maternal) is detected. However, as used herein "biomarker tests" are considered a non-nucleic acid-based test.

Amniocentesis and chorionic villus sampling (CVS)-based tests offer relatively definitive prenatal diagnosis of fetal aneuploidies, but require invasive sampling by amniocentesis or Chorionic Villus Sampling (CVS). These sampling methods are associated with a 0.5% to 1% procedure-related risk of pregnancy loss (D'Alton, M. E., Semin Perinatol 18(3):140-62 (1994)).

While different approaches have been employed in connection with specific aneuploidies, in the case of Down's syndrome, screening initially was based entirely on maternal age, with an arbitrary cut-off of 35 years used to define a population of women at sufficiently high risk to warrant offering invasive fetal testing.

Maternal biomarkers offer another strategy for testing of fetal Down's syndrome and other chromosomal aneuploidies, based upon the proteomic profile of a maternal biological fluid. "Maternal biomarkers" as used herein refer to biomarkers present in a pregnant female whose level of a transcribed mRNA or level of a translated protein is detected and can be correlated with presence or absence of a chromosomal abnormality.

Second-trimester serum screening techniques were introduced to improve detection rate and to reduce invasive testing rate. One type of screening for Down's syndrome requires offering patients a triple-marker serum test between 15 and 18 weeks gestation, which, together with maternal age (MA), is used for risk calculation. This test assays alpha-fetoprotein (AFP), human chorionic gonadotropin (beta-hCG), and unconjugated estriol (uE3). This "triple screen" for Down's syndrome has been modified as a "quad test", in which the serum marker inhibin-A is tested in combination with the other three analytes. First-trimester concentrations of a variety of pregnancy-associated proteins and hormones have been identified as differing in chromosomally normal and abnormal pregnancies. Two first-trimester serum markers that can be tested for Down's syndrome and Edwards syndrome are PAPP-A and free .beta.hCG (Wapner, R., et al., N Engl J Med 349(15):1405-1413 (2003)). It has been reported that first-trimester serum levels of PAPP-A are significantly lower in Down's syndrome, and this decrease is independent of nuchal translucency (NT) thickness (Brizot, M. L., et al., Obstet Gynecol 84(6):918-22 (1994)). In addition, it has been shown that first-trimester serum levels of both total and free .beta.-hCG are higher in fetal Down's syndrome, and this increase is also independent of NT thickness (Brizot, M. L., Br J Obstet Gynaecol 102(2):127-32 (1995)).

Ultrasonography-based tests provide a non-molecular-based approach for diagnosing chromosomal abnormalities. Certain fetal structural abnormalities are associated with significant increases in the risk of Down's syndrome and other aneuploidies. Further work has been performed evaluating the role of sonographic markers of aneuploidy, which are not structural abnormalities per se. Such sonographic markers employed in Down's syndrome screening include choroid plexus cysts, echogenic bowel, short femur, short humerus, minimal hydronephrosis, and thickened nuchal fold. An 80% detection rate for Down's syndrome has been reported by a combination of screening MA and first-trimester ultrasound evaluation of the fetus (Pandya, P. P. et al., Br J Obstet Gyneacol 102(12):957-62 (1995); Snijders, R. J., et al., Lancet 352(9125):343-6 (1998)). This evaluation relies on the measurement of the translucent space between the back of the fetal neck and overlying skin, which has been reported as increased in fetuses with Down's syndrome and other aneuploidies. This nuchal translucency (NT) measurement is reportedly obtained by transabdominal or transvaginal ultrasonography between 10 and 14 weeks gestation (Snijders, R. J., et al., Ultrasound Obstet Gynecol 7(3):216-26 (1996)).

Kits

Kits often comprise one or more containers that contain one or more components described herein. A kit comprises one or more components in any number of separate containers, packets, tubes, vials, multiwell plates and the like, or components may be combined in various combinations in such containers. One or more of the following components, for example, may be included in a kit: (i) one or more amplification primers for amplifying a nucleotide sequence species of a set, (ii) one or more extension primers for discriminating between amplified nucleic acid species or nucleotide sequence species of each set, (iii) a solid support for multiplex detection of amplified nucleic acid species or nucleotide sequence species of each set (e.g., a solid support that includes matrix for matrix-assisted laser desorption ionization (MALDI) mass spectrometry; (iv) reagents for detecting amplified nucleic acid species or nucleotide sequence species of each set; (vi) a detector for detecting the amplified nucleic acid species or nucleotide sequence species of each set (e.g., mass spectrometer); (vii) reagents and/or equipment for quantifying fetal nucleic acid in extracellular nucleic acid from a pregnant female; (viii) reagents and/or equipment for enriching fetal nucleic acid from extracellular nucleic acid from a pregnant female; (ix) software and/or a machine for analyzing signals resulting from a process for detecting the amplified nucleic acid species or nucleotide sequence species of the sets; (x) information for identifying presence or absence of a chromosome abnormality (e.g., a table or file thats convert signal information or ratios into outcomes), (xi) equipment for drawing blood); (xii) equipment for generating cell-free blood; (xiii) reagents for isolating nucleic acid (e.g., DNA, RNA) from plasma, serum or urine; (xiv) reagents for stabilizing serum, plasma, urine or nucleic acid for shipment and/or processing.

A kit sometimes is utilized in conjunction with a process, and can include instructions for performing one or more processes and/or a description of one or more compositions. A kit may be utilized to carry out a process (e.g., using a solid support) described herein. Instructions and/or descriptions may be in tangible form (e.g., paper and the like) or electronic form (e.g., computer readable file on a tangle medium (e.g., compact disc) and the like) and may be included in a kit insert. A kit also may include a written description of an internet location that provides such instructions or descriptions (e.g., a URL for the World-Wide Web).

Thus, provided herein is a kit that comprises one or more amplification primers for amplifying a nucleotide sequence species of one or more sets. In some embodiments, one or more primers in the kit are selected from those described herein. The kit also comprises a conversion table, software, executable instructions, and/or an internet location that provides the foregoing, in certain embodiments, where a conversion table, software and/or executable instructions can be utilized to convert data resulting from detection of amplified nucleic acid species or nucleotide sequence species into ratios and/or outcomes (e.g., likelihood or risk of a chromosome abnormality), for example. A kit also may comprise one or more extension primers for discriminating between amplified nucleic acid species or nucleotide sequence species of each set, in certain embodiments. In some embodiments, a kit comprises reagents and/or components for performing an amplification reaction (e.g., polymerase, nucleotides, buffer solution, thermocycler, oil for generating an emulsion).

EXAMPLES

The following Examples are provided for illustration only and are not limiting. Those of skill in the art will readily recognize a variety of non-critical parameters that can be changed or modified to yield essentially similar results.

Example 1: Use of Paralogs and the Problem of Variance with Samples that Comprise Heterogenous Extracellular Nucleic Acid Template Aneuploidies such as Down syndrome (DS) are chromosomal disorders genotypically associated with severe or complete duplication of a chromosome resulting in three (3) copies of the chromosome. In the case of trisomy 21, determining the number of genomic DNA copies of chromosome 21 is the primary step in the diagnosis of T21. The compositions and methods described herein provide a PCR-based chromosome counting technique that utilizes highly homologous genomic nucleotide sequences found in at least two different chromosomes.

Highly homologous sequences often are a type of genomic segmental duplication ranging between one to hundreds of kilobases that exhibit a high degree of sequence homology between multiple genomic regions. These sequences can be classified as either intrachromosomal, within the same chromosome, or interchromosomal, within different chromosomes. In certain portions of highly homologous interchromosomal regions, there can be instances were only two regions of high homology exist on two different chromosomes, such as chromosome 21 and chromosome 14 as depicted in FIG. 1.

Thus, provided are highly homologous species of nucleotide sequences that share a degree of sequence similarity that allows for co-amplification of the species. More specifically, the primer hybridization sequences in the nucleotide sequence template generally are substantially identical and a single pair of amplification primers reproducibly amplify the species of a set. Each species of the set comprises one or more sequence differences or mismatches (herein also referred to as "markers") that are identifiable, and the relative amounts of each mismatch (or marker) can be quantified. Detection methods that are highly quantitative can accurately determine the ratio between the chromosomes. Thus, the ratio of the first and second nucleotide sequence is proportional to the dose of the first (target) and second (reference) sequences in the sample. In the case of more than two species in a set, the ratio of the two or more nucleotide sequences is proportional to the dose of the two or more target and reference sequences in the sample. Because of their high degree of primer hybridization sequence similarity, the nucleotide sequences provided often are useful templates for amplification reactions useful for determining relative doses of the chromosome and/or chromosome region on which these sequences are located.

Variance

Before initiating the marker feasibility experiments, a series of investigative experiments and simulations were performed to help gauge and evaluate the scope and design of this marker feasibility plan. The theoretical and actual experiments that were used to shape the marker feasibility plan included:

1) Simulations of the relationship between fetal percent and marker quality/quantity on the sensitivity and selectivity of T21
2) Experiments investigating how 96-well and 384-well format affects marker assay variance
3) Experiments investigating how marker assay variance propagated through a standard TypePLEX® protocol
4) Experiments investigating how experimental processes (e.g. day-to-day, plate-to-plate) affect variance in marker assays
5) Experiments investigating how multiplex level affects marker assay variance
6) Experiments investigating how whole genome amplification techniques affect marker assay variance Objective A series of simulations was initiated to ascertain the interplay between the signal from CCF fetal DNA in the maternal background and the number and quality of interrogating markers as well as the impact of both on the sensitivity and selectivity of T21 classification.

Experimental Outline

Using a given range of maternal background DNA and fetal DNA contribution of 1500 copies of total DNA and 15% fetal contribution and a standard TypePLEX assay variation of 3% (CV=3%), simulations were run to determine the effect of increasing the number of markers on the classification of euploid and T21 aneuploid fetal samples. Holding these values constant allowed for a general assessment of the number and quality of markers needed to achieve various classification points using sensitivity and selectivity metrics.

Conclusions

Figure 3:
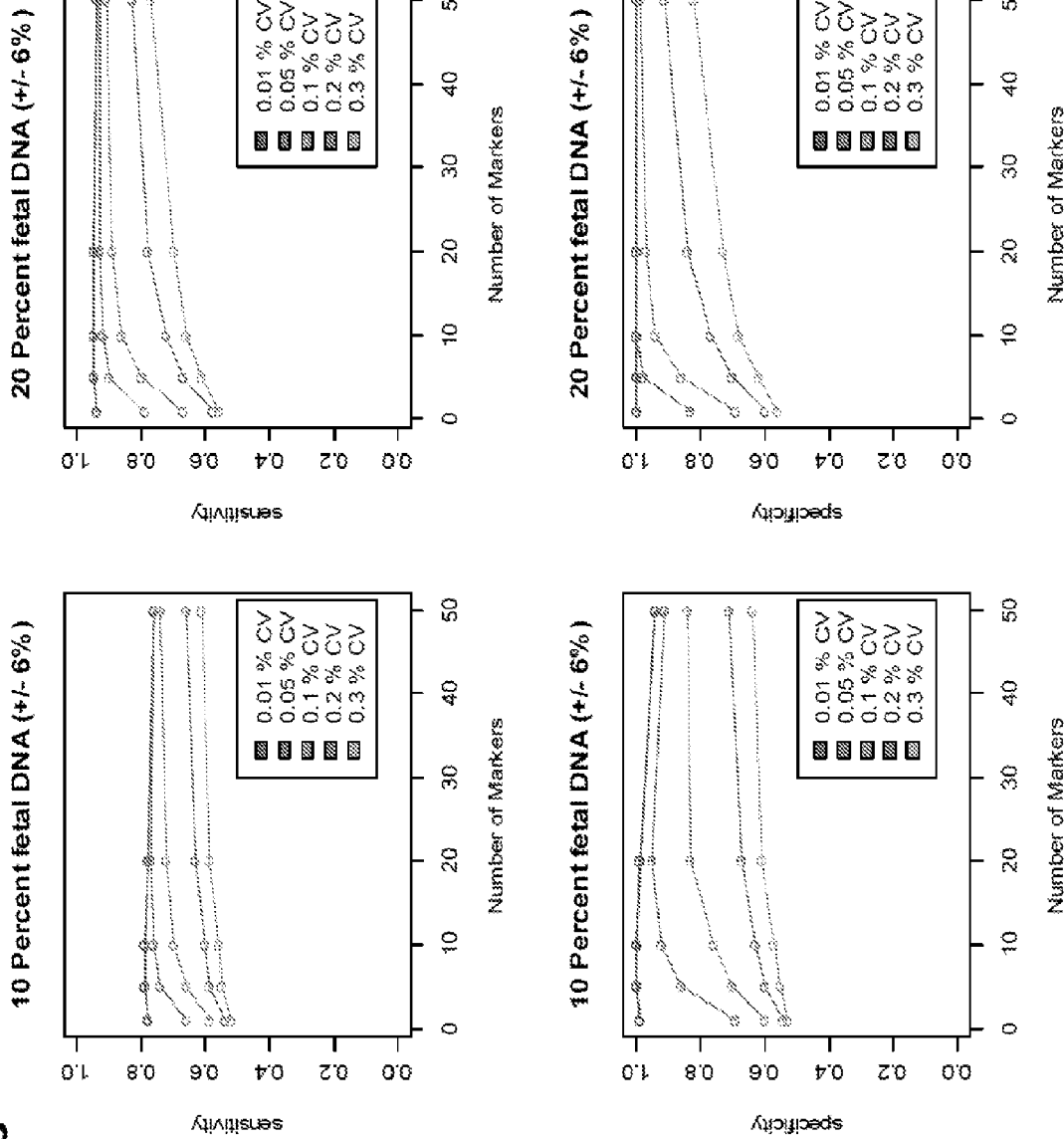
FIG. 3 shows simulations where fetal concentration (10% vs 20%) versus decreasing coefficient of variation (CV) versus sensitivity and specificity are graphed.

Simulations resulted in a series of observations:
1) A single or a few markers is insufficient to classify T21 aneuploid samples at an acceptable level (See FIG. 2)
2) Increasing the number of markers improves the classification of T21 aneuploid samples (See FIG. 2)
3) Quality markers, those that exhibit the lowest CV, have a larger impact than increasing the number of markers (See FIG. 3)
4) An increase in fetal DNA percent from 10 to 20% has a large impact on the sensitivity and selectivity of the markers (see FIG. 3)

These simulations indicated a few axioms that will be carried throughout the feasibility study: First, the marker feasibility must generate a very large pool of markers so that enough quality markers are identified. Specifically this means that markers from all other chromosomes, with the exception of the sex determination chromosomes X and Y, will be include in the screening process. Additionally, quality metrics of the markers including CV will be central in the marker selection process during the FH feasibility study.

Propagation of Process Variance Using Sequenom® TypePLEX® Biochemistry

Objectives

Since the highly homologous DNA approach requires discriminating between small differences between T21 and normal samples, it is imperative to minimize the measurement variability to have a successful assay. The purpose of this first experiment was to empirically determine the contribution of each step in the TypePLEX process (PCR, SAP, primer extension, MALDI-TOF MS) to the overall measurement variability. TypePLEX biochemistry is further described in Example 3 below.

Experimental Outline

A 96 well PCR plate consisting of replicates of a single gDNA sample and a single multiplex was created. Wells were pooled and re-aliquotted at various stages of the post-PCR process in order to measure the variance of each step sequentially.

Results Overview

Figure 4:
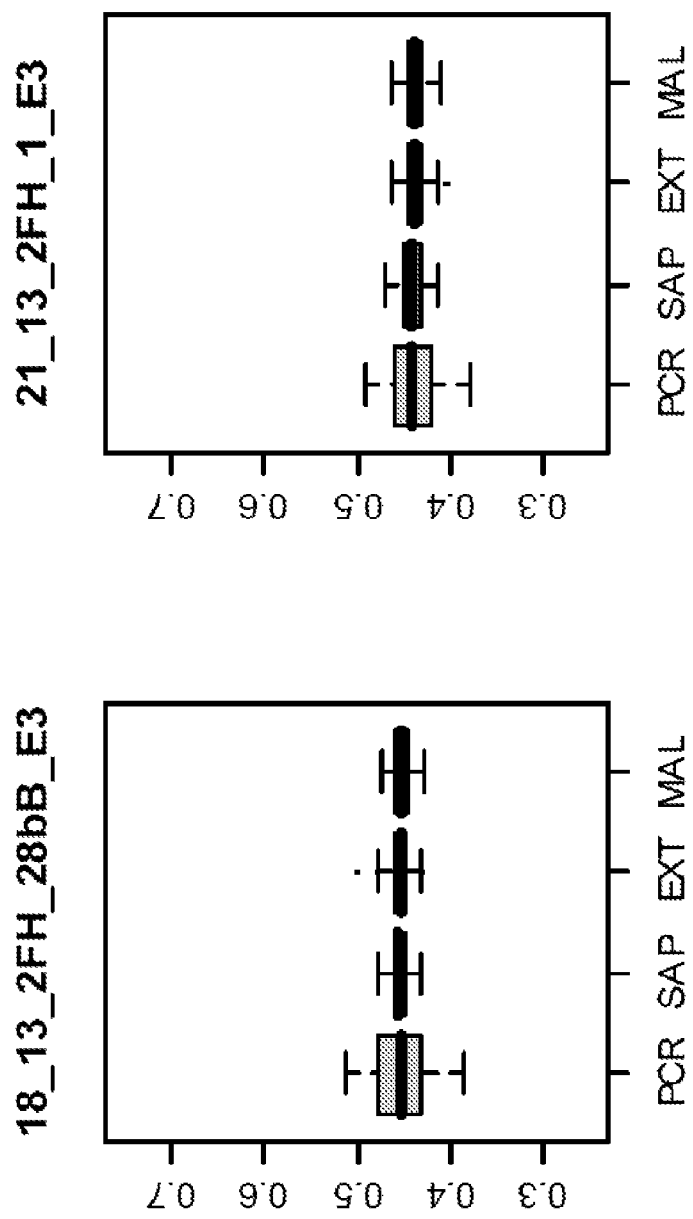
FIG. 4 shows different levels of variance for different steps of detection and quantification by Sequenom MassARRAY, which includes amplification (PCR), dephosphorylation using Shrimp Alkaline Phosphatase (SAP), primer extension (EXT) and identification and quantification of each nucleotide mismatch by MALDI-TOF mass spectrometry (MAL).

The boxplots in FIG. 4 show the allele frequency of two different sets of markers with variance isolated at different steps in the measurement process. In both cases, the variances of the post-PCR steps are all very similar and all markedly smaller than the PCR variance.

Conclusions

The PCR step contributes the most to the overall measurement variability. This preliminary study on process variance, coupled with the 96 vs 384-well study on variance, indicate that minimizing marker variance is best achieved at the PCR step. As a result, in this feasibility PCR will be performed on a larger aliquot of sample, minimizing sampling variance, and the 96-well 50 μL PCR reaction volume reducing reaction variance. Also, methods that reduce amplification variability (e.g., amplification is done in many replicates) or do not have an amplification step (e.g., sequencing and counting of highly homologous sequence sets) may be employed.

Variance in Experimental Procedures

Objectives

Measure the day-to-day process variability of the same data set and, in a separate experiment, determine the variability of measuring the same analyte over several days and several weeks.

Experimental Outline

Over the course of four consecutive days, the same 96 well PCR plate consisting of a single sample and single multiplex was created, one plate per day. The four plates underwent post-PCR processing using the same procedures and reagents, but each plate was processed on a different day.

For the second experiment, a single PCR plate was generated and processed following PCR. Once it was ready to be spotted for MALDI measurement, it was spotted for four days per week over four consecutive weeks, with the extension products stored at 4 C in between each measurement.

Results Overview

The frequency of two assays was determined from the day-to-day variability experiment. The median frequency over four consecutive days was essentially the same for assay 21_13_2FH_13_E3, while assay 21_13_2FH_2_E3 shows significant differences over the same time frame. In another experiment, the reproducibility from spotting from the same plate repeatedly over four weeks was determined. Assay 18_13_2FH_28bB_E3 shows low frequency variance during the experiment while a different assay on the same plate, 21_13_2FH_2_E3, shows high variability throughout.

Conclusions

Both the day-to-day variability and spotting reproducibility experiments show that measurements from some assays are stable over time while measurements from others vary quite significantly, depending on the day the analytes are measured. With regards to the feasibility study, process variability is shown to be correlated with the inherent properties of specific markers; therefore, those markers displaying high variability will be removed during the marker screening process.

Example 2: Identification of Nucleotide Sequence Species Useful for Detecting Chromosomal Abnormalities Methods After identifying the sources of variability in the process, suitable markers were identified, screened (in silico) and multiplexed. First, a set of programs and scripts were developed to search for all the paralogous (highly homologous) sequences from the target chromosome (e.g., Chr 21) and reference chromosomes (e.g., all other, non-target autosomal chromosomes). Genome sequences from the Human March 2006 Assembly (hg18, NCBI build 36) were screened. To identify polymorphic base(s) in the sequences, dbSNP build 129 (followed by dbSNP build 130 when it became available) was used.

Next, chromosome 21 (Chr 21) was divided into smaller fragments as probes. Since the desired assays typically target sequence lengths of 80-120 base pairs (bp), Chr 21 was divided into 150 bp fragments with 50 bp overlaps between adjacent fragments. This setting worked well for manual assay screening where more than 100 additional base pairs from each end were added to each stretch of homologous regions found. To capture the possible paralogous sequences near the edge of each search region in the automatic assay screening, 150 bp fragments with 75 bp overlaps, 100 bp fragments with 50 bp overlaps, and finally 100 bp fragments with 75 bp overlaps were all used. Based on these different screening strategies and an optimal amplicon length of 100 for TypePLEX assays, the best strategy appeared to be breaking up Chr 21 into 100 bp fragments with 75 bp overlaps.

Repeat sequences in each chromosome were masked by lower case in the genome and unknown sequences were denoted by N's. Fragments containing only repeat sequences or N's will not generate useful paralogous sequences; therefore, they were identified and omitted.

Unique, paralogous regions of chromosome 21 were identified in other chromosomes by aligning fragments of Chr21 with all the chromosomes in the genome (including Chr21) using BLAT (the BLAST-Like Alignment Tool). All fragments having paralogs with a homology score more than 85% and alignment length greater than 75 were pooled. Target fragments matching a single reference chromosome were selected. Fragments with multiple (more than 1) matches were not included.

Next markers from the paralogous sequences were identified using Biostrings package in R. Some paralogous sequences derived from above analysis contained large insertions in the high homology regions on the reference chromosome. These kinds of sequences were thus filtered with the span limit of 500 bp on the reference chromosome. The paralogous segments were then merged into single sequence if they were overlapping or close to each other (<=100 bp) on both Chr 21 (target) and the 2nd (reference) chromosome. RepeatMask regions and SNPs from dbSNP 130 were identified in the chromosome sequences and masked as "N" before the alignment. The paralolgous sequences from chromosome 21 and the reference chromosome were then pairwise-aligned to locate the exact mismatch locations. Several mismatches might be found from single paralogous region. Each mismatch was prepared as a mock SNP (or mismatch nucleotide) on the sequence for proper input format of the Assay Design program, and all the other mismatch positions on the same paralogous region were masked as "N" to prevent or reduce the occurrence of PCR primers or extension primer being designed over it.

Unsuitable sequences were filtered out and the remaining sequences were grouped into SNP sets. The initial markers contained all the potential mismatch sites within the paralogous regions, regardless of the sequence context. Most of the sequences could not be used due to lack of suitable PCR primers or extend primer locations. They were filtered out using Sequenom's Assay Designer with standard iPLEX® parameters for uniplex. Those assays successful for uniplex designs were then run through additional programs (Sequenom's RealSNP PIeXTEND) to ensure PCR and extend primers had high specificity for the target and reference sequences. Sequences were then sorted first by the second chromosome and then by sequence variation position on Chr 21. Sequence IDs were generated by the following convention: 2FH[version letter]_21_[2nd chr number]_[sequence index], where [version letter] is a letter indicating the version for the screening effort, [2nd chr number] is the second chromosome number in two digits and [sequence index] is the sequence index restarted for each chromosome in 0 padded three or four digits format.

In a further consideration, markers that were in close proximity to each other were not plexed to the same well due to cross amplification. All sequences were first sorted by marker position on chromosome 21. Each sequence was assigned a SNP set ID, and markers within a distance of less than 1000 bp were assigned the same SNP set ID. The SNP set IDs could be checked by Assay Designer to ensure that assays with same SNP set ID would be placed into different wells. It is possible that markers more than 1000 bp apart on chromosome 21 map to another chromosome with distance less than 1000 bp. However, if they happen to be designed into the same well, running the assays through PIeXTEND will be able to successfully identify them.

Results

Table 3 summarizes the results of marker screening for chromosome 21. Initially probes of 150 bp fragments with 50 bp overlaps from chromosome 21 were used. This strategy yielded 3057 homologous regions, from which 7278 markers (nucleotide mismatch sequences or "mock SNPs) were found for chromosome 21 versus another autosomal chromosome. Uniplex assay design considerations for these sequences showed that 1903 sequences could be designed while 5375 failed (73.9%), mostly due to lack of suitable PCR primers or extension primer.

Next, screening was performed with 150 bp probes with 75 bp overlaps, 100 bp probes with 50 bp overlaps and finally 100 bp probes with 75 bp overlaps. The 100 bp probes with 75 bp overlaps provided nearly complete coverage of all the homologous regions of chromosome 21 against the entire genome. With these probes, 2738 sequences were found successful for uniplex design with SNPs from dbSNP 129 annotated into the sequences. Since dbSNP 130 contains more SNPs than dbSNP 129, only 2648 sequences were found successful for uniplex design with this new database. The 2648 uniplex assays were run through realSNP PIeXTEND. Three assays were found to have false extensions (invalid target for the extend primer from amplicons produced by the primer pair), and 216 assays have 3 or more hits by the PCR primer pair. 2429 assays have intended 2 hits in the genome (one on chromosome 21 and one on another autosomal chromosome)

Shorter probes and longer overlaps resulted in more successful assay targets. See Table 3. However, longer probes and shorter overlaps did produce some additional successful sequences that were not present in the final screen with 100 bp probes and 75 bp overlaps. These sequences were added to the final sequence set. The final number of unique markers for chromosome 21 and the reference autosomal chromosome was 2785. Excluding false hits and 3+ hits, there were 1877 markers available for T21 assay screen. These 1877 markers were carried forward for further Sequenom MassEXTEND assay design.

In Table 3, the different versions (A, B, C, etc.) refer to the different probe to overlap lengths. The number of sequences that met the criteria for each version as well as the number that fell out are provided.

for the initial test panel using 'mix-1' assays, and how analysis of the experimental results prompted some further parameterization. It will then detail the specific methods of the design process used to generate TypePLEX assays. The Results section presents a summary of the T21 2FH TypePLEX assay designs.

Background

Typical MassEXTEND assays are designed and run to analyze single nucleotide polymorphisms (SNPs) in DNA samples. With respect to assay design, the first task is amplification of a short region flanking the SNP site using PCR. A specific probe primer (a.k.a. extend primer) then hybridizes to the amplified sequence adjacent to the SNP site and is extended by incorporation of a nucleotide species that reads (complements) the specific nucleotide at that site. The resulting extended probe primers (analytes) are subsequently identified by the intensity of their expected mass signals (peaks) in a mass spectrum of the crystallized MassEXTEND reaction products. A typical genotyping assay will look for one of two alternative nucleotides (alleles) in diploid DNA so that either a single peak is identified, for a homozygous sample, or two equal-intensity

TABLE 3

Nucleotide Sequence Species Identification Results

| | | version | | | | | |
|---|---|---|---|---|---|---|---|
| | | A | B | C | E | F | 2FH21F |
| Marker screen | Chr21 fragment Length/overlap | 150/50 | 150/75 | 100/50 | 100/75 Repeat dbSNP 129 | 100/75 Repeat dbSNP 130 | Final Sequences (100/75 repeat plus additionals from earlier screen) |
| | input region | 3057 | 3697 | 6096 | 12606 | 12606 | |
| | output mockSNPseq | 7278 | 8082 | 9150 | 12650 | 12533 | |
| Designable assay screen | Failed by Assay Designer | 5375 | 6060 | 6922 | 9912 | 9885 | |
| | % failed | 73.9% | 75.0% | 75.7% | 78.4% | 78.9% | |
| | Uniplex Designed | 1903 | 2022 | 2228 | 2738 | 2648 | 2785 |
| | Additionals | 76 | 48 | 13 | / | / | |
| PleXTEND | Number of false hits | 1 | 1 | 1 | 3 | 3 | |
| | Number of 0 hits | 0 | 0 | 0 | 0 | 0 | |
| | Number of 1 hits | 44 | 66 | 69 | 0 | 0 | |
| | Number of 2 hits | 1788 | 1875 | 2047 | 2519 | 2429 | 1877 (excl H.PCR >300) |
| | Number of 3+ hits | 70 | 80 | 111 | 216 | 216 | |

Example 3: Assay Design for Nucleotide Sequence Species Useful for Detecting Chromosomal Abnormalities Introduction Below is a detailed account of the process used to design MassEXTEND® assays to test for (fetal) chromosome 21 trisomy, as performed on the Sequenom MassARRAY® platform.

The Background section will first discuss general assay design problems and their semi-automated solutions using software developed at Sequenom. It will then discuss the similarity and differences in application of these solutions with respect to quantifying marker signals for highly homologous (paralogous) regions. The Methods section will first discuss the general design process, as it was developed peaks are identified, for a heterozygous sample. More generally, the signal intensities may be used as a measure of the relative frequency of the alleles, e.g. when considering pooled samples, and the sequence variation may be more complex, e.g. a tri-allelic SNP, INDEL (insertion/deletion) or MNP (multiple nucleotide polymorphism), so long as the individual alleles may be uniquely distinguished by a single base extension (SBE) of the probe. For the remainder of this report the term 'SNP' will be used more generally to refer any specific sequence variation between homologous sequences.

For a single MassEXTEND assay design the main concern is with oligo primer design. Each primer sequence must hybridize to its target specifically and with sufficient strength, as estimated by its predicted temperature of hybridization (Tm). In particular, there should be little chance for false extension, i.e. that the primers could target an alternative extension site or extend against themselves through relatively stable primer-dimer or hairpin substructures. However, it is relatively inefficient and uneconomical to analyze multiple SNPs in separate wells of a MassARRAY plate, and so the more general problem for assay design is to create sets of SNP assays that can be run in parallel in the same reaction space. This process is referred to as multiplexed assay design.

The first challenge for multiplexed assay design is ensuring that all expected mass signals from individual assays in a well, including those for analytes, un-extended probes and anticipated by-products such as salt adducts, are sufficiently well resolved in a limited mass range of an individual mass spectrum. Since the probe primer must hybridize adjacent to the SNP site, the freedom to design assays for mass multiplexing is restricted to adjusting the primer lengths and, in most cases, design in either the forward or reverse sense of the given SNP sequence. Additional design options, such as adding variable 5' mass tags, may be used to increase this freedom. An equally important consideration is the additional potential for false extension of the individual assay primers with respect to targeting any other primers or amplification products of assays they are multiplexed with. Such issues may be avoided or minimized by considering alternative combinations of SNP sequences to assay in the same well. Other factors used to evaluate (i.e. score) alternative multiplexed assay designs help to avoid competitive effects that could adversely bias the performance of some assays over others, e.g. favoring multiplexes where amplicon length and PCR primer Tm values have the least variation between assays. Hence, given larger numbers of SNPs, the typical goal for multiplexed assay design is to create as few wells containing as many assays as possible, while also ensuring that each well is a high-scoring alternative with respect to individual and multiplexed assay design features.

Automated multiplexed assay design for SNP sequences has been routinely performed using the MassARRAY Assay Design Software since 2001. To date, a great many assay designs produced by the software have been validated experimentally. Enhancements to the software, chemistry, and all aspects of experimental procedure and data analysis, today allow the Sequenom MassARRAY platform to measure allele ratios to high accuracy at relatively high assay multiplexing levels. Using a computer program to design assays removes all potential for human error and ensures many suspected and observed issues of multiplexed MassEXTEND assay design are avoided. However, it is still quite common for a fraction of assays to exhibit relatively poor performance in application. Individual assays may show highly skewed heterozygous allele signals, unexpected loss of heterozygosity or even fail to produce any extension products. In most cases the reason for poor assay performance is believed to be biological in nature, i.e. due to the general validity of the given SNP sequences rather than a limitation in their subsequent assay design. For example, a given sequence may be inaccurate when compared to the current genome assembly or the region of interest may contain other SNPs that were not demarked, thereby preventing the Assay Design Software from inadvertently designing primers over these locations. Either or both PCR primers may be designed for regions that are non-specific to the genome because, for example, they overlap with an alu sequence, are subject to copy number polymorphism or are paralogous to other regions in the genome.

The assay design procedure is assisted by additional bioinformatic validation; in particular the use of the eXTEND Tool suite at the Sequenom RealSNP website to prepare input SNP sequences and validate multiplexed assay design against the human genome (Oeth P et al., *Methods Mol Biol.* 2009; 578:307-43). The first stage of input SNP sequence validation uses the ProxSNP application to BLAST the sequences against the current golden path (consensus human genome assembly) sequence. Those sequences that have high homology to exactly one region of the genome are reformatted to include IUPAC character codes at sites where other (proximal) SNPs are registered or 'N's to indicate mismatches to the genomic sequence or unknown bases. It is recommended that the reformatted SNP sequences are then given to the PreXTEND application for further validation and PCR primer design against the genome. This application first uses the same procedure for selecting pairs of PCR primers as the Assay Design Software but generates, by default, 200 of the best scoring amplicon designs rather than just the top scoring design. These are then tested using the eXTEND tool that searches for primer triplets; two PCR primers and either the forward or reverse sequence adjacent to the assay SNP. If a primer triplet matches the genome exactly once with the expected sense orientations and relative positions, the input SNP sequence is reformatted so that the aligned PCR primer sequences are demarked for subsequent constricted assay design. In this case, typically, all or most of the alternative PCR primer choices also align against the same region of the genome, and so the highest scoring PCR primer pair is selected. The scoring criterion is dominated by the consideration of the number and types of alternative matches found for the individual PCR primers. Typically, SNP sequences that have issues for PreXTEND primer design are removed from the input SNP group. The remaining reformatted sequences are processed by the assay design software using an option that ensures PCR primer design is taken directly from the annotated sequences. In this manner the specificity of MassEXTEND assay designs is assured with respect to targeting a single region of the genome, although copy number polymorphism, which is not represented in the golden path by repeated sequence, might remain an issue for the targeted regions. The assay designs produced may be further validated against the human genome using the PIeXTEND application, which uses the same eXTEND tool that tests for specific primer triplets. For assays that were processed through PreXTEND validation the individual primer triplet alignments to the genome should be identical. However, PIeXTEND also validates all combinations of primer triplets possible in each multiplex of assays to ensure that unintended amplification products or probe primer targets are not a significant issue.

Assay design to detect nucleotide differences in paralog DNA sequences is functionally equivalent to assay design for SNPs in a unique region of DNA. That is, the (common) sequence is unique with respect to targeted primer design and the variation at the equivalent position in this sequence is represented by the Sequenom SNP format. Rather than amplifying a single region of (diploid) DNA containing the probe-targeted SNP, two paralogous regions on different chromosomes are equivalently amplified by the same PCR primers and the probe primer equivalently targets the specific site of variation (nucleotide mismatch sequences) in each of the amplified regions. For the paralogous regions assayed, the site of variation is a specific marker to particular chromosome amplified, with one target region always being on chromosome 21 for the current study. Hence, in contrast to traditional SNP assays, these assays are always expected to give heterozygous results and are termed 'fixed heterozygous', or '2FH' assays, where the '2' refers to the targeting of exactly two paralogous regions that are unique to (two) different chromosomes. The paralogous regions do not have to be completely homologous in the regions flanking the targeted variation so long as the primers designed are specific to these regions, and amplification occurs in a substantially reproducible manner with substantially equal efficiency using a single pair of primers for all members of the set. Other sites of variation between paralog sequences, and any known SNPs within either region, must be denoted as proximal SNPs so that primers are not designed over these locations. In fact the paralogous regions typically have several sites suitable for such markers, and the corresponding SNP sequences provided for each chromosome 21 paralogous region are identical except for the particular marker site formatted as the assay SNP.

Because the targeted regions are not unique to the genome, the current eXTEND tool set (ProxSNP and PreXTEND) cannot be used annotate 2FH 'SNP' sequences. Instead, these sequences are prepared as described above in Example 2. However, the PIeXTEND eXTEND tool is of greater importance for validating such that the multiplexed assays designed by the software specifically target exactly the two paralogous regions intended and that potential cross-amplification issues due to multiplexing the PCR primers are detected. The PIeXTEND application, in combination with the assay design software, was also used in selection of the set of paralog SNP sequences used for assay design, as described in the Methods section below.

As with detecting a heterozygous SNP instance in an autosomal pair of chromosomes, it is assumed that regions containing the marker variation are co-amplified and produce mass signals of identical intensities, admitting some statistical variation due to experimental procedure. In practice, the same issues that cause variations from the 1:1 signal intensity ratios observed for SNP assays of heterozygous samples apply to 2FH assays, with the additional possibility of chromosome-specific biasing. For T21 (chromosome 21 trisomy) 2FH assay design, the requirements for the sensitivity and specificity are greater than for a standard MassEXTEND allelotyping experiment. In particular, the measurement of allele ratios must be accurate enough to detect aneuploid (trisomic) heterozygous allele contribution from fetal DNA superimposed on the 2FH allele signals of the mother's DNA. Hence, the design criteria for effects that could possibly result in (sample-specific) allele skewing are set to be more stringent than for standard multiplexed assay design. The use of more stringent assay design restrictions is viable because the number of paralog SNP sequences provided for initial assay design (~2,000) is considerably greater than the number required for initial experimental validation (~250).

Additionally, it is anticipated that some (the majority) of run assays may still not meet the sensitivity and specificity requirements or be otherwise less suitable. Hence, from an initial test of a larger number of TypePLEX assays (e.g. 10×25 plexes) the 'best' assays will be selected and re-designed by the software using a 'replexing' option to create the targeted number of assays. The ultimate goal is to create 50 to 60 validated assays in three wells to test for chromosome 21 trisomy. This number of assays is to increase the sensitivity of detecting fractional allele variations over a background of experimental, and perhaps biological, variations.

Methods

The current procedure for T21 2FH paralog sequence selection, assay design and assay validation was devised over a series of iterations that culminated in the testing of 250 assays against sample DNA and a 56-assay panel against euploid and aneuploid plasma samples. These tests employed a slightly different SBE (single base extension) terminator mix to the ultimate panel based on Sequenom TypePLEX assays. The viability of these assays were analyzed and subsequent assay rankings considered for correlations to addressable assay design criteria. As a result, some additional assay design restrictions were specified for the TypePLEX assay design. A summary of the general methods used to create the original "mix-1" assay panel and relevant conclusions from this study are presented here, followed by a more detailed account of the methods used for the TypePLEX assay design.

Summary of 2FH "Mix-1" Test Panel Design and Evaluation

The original 2FH assay designs were created using a modified version of the most recent version of the Assay Design software (v4.0.0.4). This modified version of the software (v4.0.50.4) permitted assay design for the "mix-1" SBE chemistry, which uses a mix of standard deoxy-nucleotide-triphosphates (dNTPs) and acyclo-nucleotide-triphosphates (acNTPs). Further, this version was modified to allow only A/G and C/T SNP assay design. This was to ensure that a pair of alleles did not require both dNTP and acNTP probe extensions, which would be a likely source of allelic skewing. The imposed restriction also disallowed a small number of the input 2FH sequences that were INDEL or MNP paralog variations.

Initial attempts at assay design for the selected 2FH markers resulted in multiplexed assays that did not give the expected specificity to the human genome when validated using the PIeXTEND web tool. Some of the assays targeted more or fewer regions than the two expected for 2FH sequences. As a result, the initial screening for suitable paralog sequences involved an additional filtering step that employed the modified version of the software to design uniplex assays that were further screened using PIeXTEND. All sequences that had assays that did not map exactly to the expected chromosome targets were discarded from the set of 2FH markers. Similarly discarded were markers for assays that gave NULL hits to the genome, i.e. assays that would amplify a region that did contain a suitable probe target sequence. To ensure PCR primer specificity to the genome, the selected markers were further reduced to those that only had both PCR primers that individually gave 300 or less matches to the genome. The default settings for a PIeXTEND test uses quite loose criteria for PCR primer alignment: A match is recorded for a given primer using the 16 most 3° bases, containing up to one base mismatch after the first 3 most 3° ' bases. Running PIeXTEND using the 18 most 3° bases of the PCR primers (with no mismatches) confirmed that PCR primers designed for the remaining 2FH sequences were quite specific to the amplified regions, with few assays returning more than 2 hits for both PCR primers.

A total of 1,877 paralog SNP sequences were provided for assay design composed of the ultimate 2FH21F screen plus 56 sequences from earlier screens (see Example 2). Five sequences, all from the earlier screens, were subsequently removed as a result of scanning for assays that could preferentially target one paralog region of the genome due to sequence variations, depending on the assay design direction selected. Of the 1,872 paralog sequences used for assay design, only 1,015 were designable to mix-1 assays. Most 2FH sequences that failed assay design (817 of 857) did so because of the restriction the input sequence to either [A/G] or [C/T] SNPs.

The objective for this part of the initial assay design process was to create as many 25-plex assays as possible using standard designs settings with extra restrictions, as used and described in detail for the creation of TypePLEX assays in the next section. In particular, the option to extend probe sequences using non-templated bases was disabled to prevent the possibility of a non-templated base addition that happened to actually match a SNP or paralog variation at one target site, as was previously identified as a rare exception for early designs that resulted in unexpected PIeXTEND hits (<2). Despite the increased restrictions on assay design, a relatively high yield of 25-plex mix-1 assays were created for the designable sequences because of the small mass difference between the A/G and C/T analyte masses (15 Da and 16 Da respectively).

An important criterion for 2FH assay design is that no multiplex well design should have more than one assay that targets a particular chromosome 21 paralog region. For each pair of paralog regions there are typically multiple sites of sequence variation that are suitable for MassEXTEND assay design. If two assays were designed in the same well for the same region then there could be a competition between PCR primers trying to amplify within these small regions of the genome. To avoid this, each chromosome 21 paralogous region is denoted a unique SNP_SET value. The SNP group file provided includes a SNP_SET field and is such that each paralog variation for the same SNP_SET value is given a unique SNP_ID and targets just one paralog sequence variation. Each specific variation site is denoted by the assay SNP format, with all other variations demarked as proximal SNPs ('N'). Exclusion of assays in multiplexes based on their SNP_SET value is then achieved using the 4.0 Assay Design software feature SNP Representation: Once per well.

An initial secondary concern was to ensure that some multiplex designs give as much paralog chromosome coverage as possible. To achieve this, a copy of the SNP group file is edited to use the paralog chromosome ID as the SNP_SET values. This input was used to produce well designs at up to 21-plex where each member assay targets a paralog region in a different chromosome (1-20, 22). The first 10 wells were retained in a copy of the result assay group design and then 'superplexed' up to the 25-plex level in a second assay design run against the original SNP group file, containing the chr21 indices as the SNP_SET values. Superplexed assay design is the software option to design new input SNP sequences to add to existing assay designs, as possible, or create additional new well designs. Since the definition of the SNP_SET grouping is only specified by the SNP group file, the net result is a set of well designs containing 25 (or less) assays, that must each target a different chromosome 21 paralog region (SNP_SET) and where the first 10 multiplexes have the maximum number of assays targeting regions in different paralog chromosomes.

The two-pass design strategy allows for a greater choice when picking a limited number of well designs to test. For the mix-1 designs thirty one 25-plex wells were created, of which 10 were selected including the first four wells that contained at least one assay that targeted each of the 21 paralog chromosomes (1-21, 22). Analysis of the experimental results for these ten 25-plexes for euploid samples led to a quality ranking of the individual assays. Three wells were chosen to run against the plasma tissue samples, including the first 25-plex and 19-plex designed by employing the re-multiplex replex design option of the Assay Design software the assays for the top 50 ranked model assays.

Simple RMS analysis using plots of model assay rankings against various assay design features showed some very general expected trends but no significant correlation based on $R^2$ values. Considered design features included predicted probe hybridization Tm; probe length; percentage GC sequence content in both probe and amplicon sequences; the number and severity of individual assay design warnings; amplicon length and paralog amplicon length variation; the number of paralog variations in both the amplicons and SNP_SET region; and the probe mass. The lack of correlation of assay performance to assay design features indicated that no further restrictions on future 2FH assay design with respect to these features was necessary. In particular, it was not necessary to reduce the upper mass limit (8,500 Da) for assay analyte design, which would entail a reduction in the multiplexing levels achievable.

A lack of correlation to assay performance was also noted when considering the (excess) numbers of hits of the PCR primers to the genome, as reported for PIeXTEND analysis at various PCR primer and probe matching settings. Most of this data was collected for all thirty one 25-plex designs and provided to assist in selection of the initial model set assays. However, this information did not provide a clear metric to choose between different multiplexes and was therefore not considered in selection of the 10 model wells. The subsequent lack of correlation to the relative specificity of the PCR p,/sds3fdrimer sequences indicates that the initial filtering of 2FH sequences for assay design does not require further restrictions based on the number PCR primer alignments to the genome. The PIeXTEND analysis of the candidate well designs revealed that three 25-plex wells had potential for cross-amplification issues between pairs of assays. Cross-amplification may occur when the PCR primers from two different assays in the same well could amplify an unintended region that may or may not contain a target for a probe in either assay. The assays that had this issue were from SNP_SETs that were close in index value. Although the spacing between these paralog regions is relatively far on chromosome 21 (well in excess of 1,000 bases), the paralog regions on the second chromosomes turned out to be considerably less (only 100-500 bases) so that an overlap of intended amplicon designs was detected by PIeXTEND. None of the three wells containing these assays were selected for the model run. However, a similar issue that occurred in the replexed assays that targeted the same SNP_SET appeared to show evidence that cross-amplification is a concern.

The highest correlation of assay performance rank to design features was noted for the PCR confidence score (UP_CONF) and the minimum predicted Tm (for target hybridization) for either of the PCR primers of an assay, which is a key component of the UP_CONF calculation. This correlation was greater when the minimum predicted Tm for PCR primers were plotted against the probe extension yield and call rate for the assays. That some PCR primers were designed with Tm's as much as 20° C. below the optimum target value of 60° C. was not anticipated and was a result of limited choice for primer design in some input strands due to a relatively high density of proximal SNP demarcations. In consequence, the settings for the minimum PCR primer design Tm was set to 50° C. for TypePLEX assay design.

Another apparent correlation of assay performance rank was observed with respect to SNP_SET index. Assays of SNP_SET index of 1 to 44 appeared to have more consistently moderate or poor rankings. These regions were closest to the 5' telomeric end of chromosome 21 and included all paralog regions to chromosome 22. Model set assays that targeted chromosome 22, and also possibly chromosomes 20, 17 and 16, appeared to have more consistently moderate or poor rankings, and may be an indication of chromosome-specific degradation. However, 25% of 2FH paralog sequences were members of SNP_SETs of index 1 to 44, and a test design without these sequences in the input set resulted in a corresponding loss of approximately 25% of the assay designs. For the TypePLEX assay designs it was decided to retain these 2FH marker sequences for design and note this observation when considering the ultimate set of assays selected for the TypePLEX T21-2FH panel.

2FH TypePLEX Assay Design

The TypePLEX assays were created using the most recent version of the Sequenom Assay Design software (4.0.0.4), employing standard TypePLEX (formally iPLEX) termination nucleotides without restriction on the particular SNPs. The same procedure of assay design and validation was followed as used for the mix-1 test run but with the modification of three design settings in the Assay Design software prompted from analysis of the mix-1 test results, as described below.

The same input set of 1,872 2FH sequences were initially used to create TypePLEX assay designs. However, PleX-TEND analysis showed that four assays had 3-hits to the genome. The corresponding 2FH sequences were removed from the SNP group to leave 1,868 input sequences. Despite the additional TypePLEX design restrictions, the lack of restriction on the allowed SNPs meant more of the input 2FH sequences are designable to assays (1,749 cf. 1,015). (In fact, all input sequences are designable to TypePLEX assays at standard design settings.) However, since individual TypePLEX assays may have allele mass differences as high as 79.9 Da, fewer high-multiplex designs may be created (25 vs. 31). With the addition of the 10 Da minimum mass separation of un-extended probe signals, less than half as many TypePLEX 25-plex wells were created compared to the mix-1 designs (15 vs. 31). Hence for the initial set of candidate assay designs, all TypePLEX well designs containing 20 or more assays were considered for testing. These assay designs were validated against using the PIeXTEND web tool on Genome Build 36 (March, 2006) at the Sequenom RealSNP website, as detailed in the Results section below. TypePLEX assay design was again performed in two steps to control which sequences of sets of 2FH were allowed to be multiplexed together in the same well. The first pass designed multiplexed assays using a Max. Multiplex Level setting of 21 and the SNP Set Restriction option set to Once per well to create wells in which each assay targeted a different paralog chromosome (1-20, 22). All assays in wells below a certain size were discarded to allow the corresponding 2FH sequences to be re-designed. The remaining assays were superplexed with the original 2FH sequences, with the chromosome 21 region as the SNP_SET value, using a using a Max. Multiplex Level setting of 25. Apart from the changes to the settings of Max. Multiplex Level and Assay Type (iPLEX then Superplex), all assay designer settings were the same for both design passes. The most important settings governing assay design features are detailed below with respect to the three primary components of assay design; amplicon (PCR primer) design, extend (probe) primer design and multiplexed assay design. Some settings relating to design options that are not relevant to standard TypePLEX assay design, or more algorithmic in nature, are not detailed here.

In the following sections, the numbers of assays or multiplexes affected by changing a particular design setting are provided. These are in respect to all other design settings being at their final values but these numbers should only be regarded as an approximate quantification of the individual design restraints, since the combination of multiple feature restraints is not represented as sum effect of applying individual restraints.

Amplicon Design Settings

The term 'amplicon' refers to the double-stranded DNA sequence that is the amplified region targeted by a PCR reaction. Amplicon design is a process of choosing the most suitable pair of PCR primers against the input sequences such that it contains the sequence variation (SNP) of interest and is within specified length requirements. For 2FH assay designs the standard settings for the minimum, optimum and maximum amplicon lengths were used; at values 80, 100 and 120 respectively. This length includes the non-targeted PCR primer 5' 10-mer hME-10 tags used in standard MassEXTEND assay design, as specified in Assay Designer Amplicons Settings dialog window. The use of universal PCR primer tags, and a small variation in small amplicon lengths, is known to enhance and assist balance of amplification rates in multiplexed PCR reactions. An exemplary universal 10 mer tag used with the assay designs provided in Table 4 is the following: ACGTTGGATG (SEQ ID NO: 1). The Sequence Annotation option is set to its default setting of Scan and Restrict. This option affects how primers are preferentially chosen if the SNP sequence is annotated using character type casing. The particular option chosen is not effective for the 2FH sequences since they are provided as all uppercase characters. This option allows any 10-mer sequence repeats affecting PCR primer design to be avoided, although it is assumed that such repeats are unlikely due to the preparation the 2FH sequence set provided.

PCR primer design consists of evaluating targeted sequences on either side of the assay SNP then choosing the suitable pair of sequences that best meet amplicon length requirements. Primer sequence must be specific and may not target a region containing demarked sequence variations, e.g. other assay SNPs, proximal SNPs denoted by IUPAC codes or otherwise masked by 'N' characters. The masking of proximal variations for 2FH sequence design contributed to the majority (95%) of design failures in combination with restraints on PCR and probe primer design.

Restrictions on primer design and weightings on individual design features, affecting how the best pair of primers is ultimately selected, are configurable to the assay design software. These are typically left at their standard default values for assay design since they have proved to be effective. The length of targeted PCR primer is constricted to between 18 and 24 bases, with an optimum length target of 20 bases. The optimum fractional G.C base content for the targeted sequence is set to 50% and the optimal predicted hybridization Tm for the sequence, using the 4+2 rule, is set to 60° C. Typical SNP sequences have sufficient scope for primer sequence selection that often all three of these optimum conditions are met, resulting in a specific and thermodynamically suitable primer design. However, this may not be the case where sequences have a high A.T base content or are restricted due to the presence of non-specific base codes. To address an observation of a possible correlation between assay performance and PCR primer predicted Tm's for the mix-1 2FH assay designs, the minimum Tm for primer design was set to 50° C., with the maximum retained at its standard value of 80° C. The application of this minimum Tm constraint resulted in the loss of 58 2FH assay designs. The score weighting settings that adjust how effectively primer design meets the optimum values for these restraints were not altered from their default values (1.0).

Other relevant settings for PCR primer design include considerations for the numbers of sequential G bases, false priming of the PCR primers to the same amplicon region and false extension of the primers against themselves due to strong dimer or hairpin substructure formation. Moderate potential for false extension of PCR primers, resulting in them becoming useless for amplification, is typically considered as only having a minor effect on PCR performance and these settings are left at their default values. However, as a result of observing a possible correlation between mix-1 assay performance and PCR design confidence score (UP_CONF), the option to include the hME-10 tags in the hairpin/homodimer analysis was enabled. This has the effect of debarring some primer designs that might have a strong potential for 3° extension against the full 5° sequence and resulted in the loss of 11 2FH TypePLEX assay designs.

Other assay design settings available for controlling single-assay amplicon design, such as score weightings for optimum amplicon length and heterodimer potential between the pair of PCR primers, were kept at their default values.

Extend Probe Design Settings

Restrictions on probe (extend) primer design are similar to those for PCR primers but length and composition is ultimately chosen based on mass and other multiplexed assay design concerns. Again, most available design settings were kept at their default values for moderate level multiplexing SBE (iPLEX) assay design, as have proved to be highly successful for multiplexed assay design in practice.

Probe primer length is controlled by the Oligo Length settings, which were set at minimum and maximum values of 17 and 30 bases respectively. The minimum value limits the size of the smallest extend primers designed and may be effectively set as low as 15 bases, since these sequences need only be specific to short strands of DNA (the amplicons resulting from PCR amplification). The higher value of 17 is used to ensure specificity, extension rates and because far more iPLEX chemistry has been performed at this setting. The maximum value governs the maximum extended length of the probes, i.e. the allele analytes anticipated. Oligo length is the primary degree of freedom for MassEXTEND assay design, along with the freedom to design either forward or reverse sense assays to target the corresponding strand of the amplicon.

The constraints on the predicted targeted Tm for probe primer design are set to a minimum of 45° C. and a maximum of 100° C., as calculated by the Nearest Neighbor method, which is the default option. The values predicted by the Assay Design software using this method are known to be about 10° C. too low because the calculation does not consider effect of Mg ions on DNA duplex stabilization. The default minimum value was initially chosen as to give approximately the same probe designs as those created by the earliest versions of the software using the 4+2 (G.C content) rule, where a 60° C. *minimum* temperature requirement had been recommended based on findings from an early hME assay design experiments. The findings did not indicate the necessity of an upper limit to probe primer Tm and the default value of 100'° C. is chosen to be significantly larger than the predicted Tm for any probes typically designable by the software. These limits have since been validated over many assay runs and used for all iPLEX assay designs. Subsequent selection of probe sequences for assay design are not dependent of the predicted Tm value, although a component of internal probe design scoring does consider the fractional G.C content relative to an optimum value of 50%. This is only a minor consideration for (alternative) probe design and the weighting factor for this component was left at its default value (1.0).

Standard assay design allows probe sequences to be extended at the 5° end with a small number bases that do not match the target DNA sequence, for the sake of mass multiplexing. This option was disabled for 2FH assay design by setting the Non-templated 5° Base Addition: Maximum Allowed value to 0. This restriction was primarily chosen so that the non-templated sequence was not designed over a proximal variation, thereby leading to differential primer hybridization to the two amplified paralog regions. Disallowing non-templated probe base extensions restricts probe design to just the specific sequence flanking the assay SNP. For the 2FH TypePLEX assays changing this setting from the default value reduced the number of 25-plexes designed by 67%.

The potential for false extension of the probe primer is given more internal weighting than for PCR primer design. Such extensions lead directly to false-positive genotyping results or significantly skewed allele frequencies. The potential for false extension is estimated by matching primer sequence to a sliding target such that the primer is able to extend (at the 3° end). Alternative extension targets include a primer molecule's own 5° tail (hairpin), another molecule of primer (homodimer) or either amplicon strand (false priming). The algorithm considers single-base mismatches, multiple-base mismatch loops and alternative choices of open and clamped loops. The largest $\Delta G$ value (most negative) for tested hybridization alignments is used to estimate the potential for extension. This estimate also includes a contribution based the number of bases in the 3° clamp of the hybridized structure, to account for a lack of general correlation of $\Delta G$ predictions with assumed instances of false extension. Settings available in the software related to Nearest Neighbor thermodynamics and extend hybridization potential were not changed from their default values.

The potential for false priming of a probe to its targeted amplicon is scored such that a relatively high $\Delta G$ prediction for partial 3° sequence hybridization exists at an alternative binding site relative to that for binding to the target site. This is typically a rare occurrence, requiring an exact complementary match of 8 to 10 bases primer at the 3° end. For the 2FH assay designs the score weighting for the probe False Primer Potential was set to 1.2. Using a feature score weighting value of 1.2 ensures that the particular feature is more heavily penalized during selection of alternative probe designs and debars assay design that would otherwise produce a high-moderate warning for the measured feature at standard settings (feature potential >0.416). For 2FH TypePLEX assays, no sequence failed design due to changing this value from the default value (1.0).

Extension of a probe primer through homodimer or hairpin hybridization is similarly analyzed. The potential for hairpin extension is typically considered moderately strong for a complementary alignment of four or more 3° bases, with a hairpin loop of 3 or more bases. The potential for dimer extension is typically considered moderately strong for a complementary alignment of five or more 3° bases, or longer alignments including one or more base-pair mismatches. For the 2FH assay designs the score weighting for the probe Hairpin/Dimer Extension Potential was also set to 1.2, to prevent extend probe designs that would a moderate warning at the default value (1.0). For 2FH TypePLEX assays, changing this value from the default value resulted in 51 sequences failing TypePLEX assay design.

Multiplexing Design Settings

Because of technical variance a single marker often is not sufficient for classification of disease state; therefore, multiple markers are required to reduce the variance and improve the accuracy. Thus, the invention provides, in part, multiplexed assays for the detection of chromosomal abnormalities from maternal samples comprising fetal nucleic acid—preferably procured through non-invasive means. A typical maternal plasma sample from a pregnant female has between 4-32% (+−2%) cell-free fetal nucleic acid. In order to reliably and accurately detect a fetal chromosomal abnormality, with sufficient specificity and/or sensitivity suitable for a high degree of clinical utility, in a background of maternal nucleic acid, sensitive quantitative methods are needed that can take advantage of the increased power provided by using multiple markers (e.g., multiple sets (from 2-1000's) of nucleotide species). By increasing both the number of sets and the number of species per set, the specificity and sensitivity of the method can be high enough for robust clinical utility as a screening test or diagnostic test—even in a sample that comprises a mixture of fetal and maternal nucleic acid. Further, the sex determination assay may be used to determine the amount of fetal nucleic acid present in the sample. Likewise, other assays to determine the amount or concentration of fetal nucleic acid present in a sample may be incorporated into the aneuploidy detection assay.

When designing multiplexed MassEXTEND assays, the primary concern of is that analyte signals from extended primers are well-resolved in the resulting mass spectrum. The molecular masses of probe primers and their extension products are easily calculated and constrained to the more conservative mass window recommended. The Lower Limit and Upper Limit values for the mass range were set to 4,500 Da and 8,500 Da respectively. This upper mass limit effectively limits maximum length for analyte sequences to 28 bases and prohibits the overlap of mass signals for singly charged (low mass) species and those for possible double and triple charged (high mass) species. The Min Peak Separation setting for analyte mass peaks was kept at its default value (30 Da). This value ensures that analyte sequences of any assay in a multiplex design do not overlap with any anticipated peaks from any other assay they are multiplexed with. It also ensures that analyte peaks are at least 8 Da separated from sodium and potassium ion adduct peaks, which are the most frequently observed salt adduct peaks in TypePLEX mass spectra. Specific additional by-product and fixed-mass contaminant signals may be specified to be avoided in multiplexed assay design but are not used for the 2FH assay designs. The Min Peak Separation setting for mass extend primers (probes) was set to 10 Da, the recommend setting for low multiplexing. This prevents un-extended probe signals in the mass spectrum from overlapping, thereby ensuring that the measurement of extension rate may be accurately estimated for all assays. (The default value of 0 was used for the mix-1 assay designs.) Adding this multiplexing restriction on the TypePLEX 2FH assay designs reduced the number of 25-plex wells created from 26 to 15 wells.

The False Priming Potential score weighting value for multiplexed primer design was set to 1.2 for the 2FH sequence designs. This reduces the likelihood that probe or PCR primers of one assay extend at an alternative site in any single-stranded amplicon sequence from another assay it is multiplexed with. This is a very low frequency occurrence at standard design settings and using a higher weighting here ensures that even moderate potentials for false priming between assays are disfavored. For 2FH TypePLEX assays, changing this value from the default value (1.0) had no significant effect on the assay designs.

The Primer-Dimer Potential score weighting value for multiplexed primer design was set to 1.2 for the 2FH sequence designs. This reduces the likelihood that a probe primer from one assay could extend off a probe primer from another assay it is multiplexed via heterodimer hybridization. As with probe homodimers and hairpins, apparent false extension has been observed at Sequenom for 3° base hybridizations with as few as 4 bases matched and is the primary reason why small sets of input sequences may fail to be multiplexed design to the same well. When the set of input sequences is large compared to the multiplexing level, as with the 2FH designs, it is usually possible to distribute probe sequences to allow for a greater number of high level multiplexes, but warnings for moderate primer-dimer extension potential are more common. Using a higher weighting here ensures that even moderate potentials for false probe extension are avoided. For 2FH TypePLEX assays, changing this value from the default value (1.0) removed 465 such warnings but reduced the number of 25-plex wells designed from 28 to 15.

Other design settings relating to multiplexing were kept at their default values. These design options are not used for standard TypePLEX assay design or not considered of particular significance for 2FH assay design. In particular, the option to use exchange replexing for de novo assay design was used and the Superplex with new SNPs option retained for superplexed assay design. The Minimum Multiplexing Level setting was set at its default value of 1, since there was no reason to restrict the wells to a minimum size at the design stage.

Results

The input set of 1,868 2FH sequences were initially designed to 1,749 assays processed in 347 wells using chromosome ID as the SNP_SET grouping. The four 21-plex, two 20-plex and five 19-plex assay design were retained for superplex assay design. These were superplexed with the original 1,868 2FH sequences at a maximum multiplexing level of 25, using chromosome region (index) as the SNP_SET grouping, to create 1,749 assays in 95 wells. From these designs, the fifteen 25-plex, thirteen 24-plex, nine 23-plex, seven 22-plex, four 21-plex and six 20-plex wells were retained as potential assay designs. The first 11 wells listed are original 21, 20 and 19 assay wells superplexed with additional 2FH sequences to well sizes of 25, 23, 23, 25, 24, 24, 22, 23, 22, 21 and 25 assays respectively.

The 54 wells, containing 1,252 assays in wells of size 20 to 25 assays, were validated by the PIeXTEND tool as all giving exactly 2 triplets of assay primer alignments to the human genome, for the expected chromosome 21 and paralog chromosome regions. PIeXTEND analysis also revealed that two wells (W27 and W53) contained pairs of assays that produced cross-amplification hits to the genome. Assays 2FH21F_01_046 and 2FH21F_01_071 were removed to avoid potential cross-amplification issues in the corresponding wells, leaving well W27 as a 23-plex and well W53 as a 19-plex. The remaining 54 wells, containing 1,250 assays, were provided for initial 2FH TypePLEX assay development. These assays are provided below in Table 4A.

In Table 4A, each "Marker ID" represents an assay of a set of nucleotide sequence species, where the set includes a first nucleotide sequence species and a second nucleotide sequence species. Table 4 provides assay details for each of the 1252 nucleotide sequence sets. As described herein, sequence sets comprise highly homologous sequences (e.g., paralogs) from a target chromosome (e.g., Ch21) and a reference chromosome (e.g., all other, non-target autosomal chromosomes). Each sequence set has a Marker_ID, which provides the target and reference chromosome numbers. For the target chromosome, the chromosome number (CHR_1), the genomic nucleotide mismatch position (Marker_POS1), the genomic strand specificity (SENSE1—F (forward) or R (reverse)), the genomic nucleotide mismatch base (Marker_1), and the amplicon length (AMP_LEN1) are provided. Corresponding information is provided for the corresponding reference chromosome: the chromosome number (CHR_2), the genomic nucleotide mismatch position (Marker_POS2), the genomic strand specificity (SENSE2—F (forward) or R (reverse)), the genomic nucleotide mismatch base (Marker_2), and the amplicon length (AMP_LEN2). Marker positions are based on Human Genome 19 from The University of California Santa Cruz (Assembly GRCh37). The PCR1 and PCR2 primer sequences amplify both the target and reference nucleotide sequences of the set, and the marker nucleotide bases are interrogated at the marker positions by the Extend primer sequence. The PCR1 and PCR2 primer sequences may also comprise a 5' universal primer sequence (e.g., the following 10-mer sequence was used in the Examples provided herein: ACGTTGGATG (SEQ ID NO: 1)). In certain embodiments, the nucleotide variant in the "Marker_1" and "Marker_2" column for an assay is the first nucleotide extended from the 3' end of an extension primer shown.

TABLE 4A

| Marker_ID | CHR_1 | Marker_POS_1 | SENSE1 | Marker_1 | AMP_LEN_1 | CHR_2 | Marker_POS_2 | SENSE2 | Marker_2 | AMP_LEN_2 |
|---|---|---|---|---|---|---|---|---|---|---|
| 2FH21F_01_003 | 21 | 17601200 | F | G | 90 | 1 | 9110229 | R | T | 90 |
| 2FH21F_01_006 | 21 | 17811372 | R | A | 91 | 1 | 52326378 | F | C | 91 |
| 2FH21F_01_007 | 21 | 17811413 | R | C | 90 | 1 | 52326337 | R | T | 90 |
| 2FH21F_01_009 | 21 | 17811526 | F | C | 119 | 1 | 52326224 | R | A | 119 |
| 2FH21F_01_010 | 21 | 17811675 | F | T | 119 | 1 | 52326075 | R | G | 121 |
| 2FH21F_01_011 | 21 | 17811688 | R | C | 117 | 1 | 52326060 | F | T | 119 |
| 2FH21F_01_012 | 21 | 17811715 | R | C | 107 | 1 | 52326033 | F | C | 109 |
| 2FH21F_01_013 | 21 | 17811745 | R | C | 98 | 1 | 52326003 | F | G | 98 |
| 2FH21F_01_014 | 21 | 17811765 | F | A | 100 | 1 | 52325983 | R | G | 100 |
| 2FH21F_01_015 | 21 | 17811858 | F | A | 118 | 1 | 52325890 | R | G | 121 |
| 2FH21F_01_017 | 21 | 17811925 | R | T | 100 | 1 | 52325820 | F | T | 100 |
| 2FH21F_01_018 | 21 | 17811943 | F | T | 100 | 1 | 52325802 | R | T | 100 |
| 2FH21F_01_020 | 21 | 17812111 | F | G | 103 | 1 | 52325634 | R | G | 103 |
| 2FH21F_01_021 | 21 | 17812175 | R | C | 91 | 1 | 52325570 | F | A | 91 |
| 2FH21F_01_022 | 21 | 17812184 | F | C | 118 | 1 | 52325561 | R | A | 118 |
| 2FH21F_01_023 | 21 | 17812224 | R | G | 118 | 1 | 52325521 | F | T | 118 |
| 2FH21F_01_025 | 21 | 17812302 | R | T | 116 | 1 | 52325443 | F | G | 116 |
| 2FH21F_01_026 | 21 | 17812307 | F | A | 116 | 1 | 52325438 | R | C | 116 |
| 2FH21F_01_027 | 21 | 21493445 | R | A | 115 | 1 | 47924051 | F | G | 116 |
| 2FH21F_01_029 | 21 | 22448020 | F | A | 84 | 1 | 33174864 | R | G | 85 |
| 2FH21F_01_030 | 21 | 27518134 | F | T | 97 | 1 | 95697485 | R | C | 97 |
| 2FH21F_01_031 | 21 | 27518141 | R | T | 97 | 1 | 95697492 | F | C | 97 |
| 2FH21F_01_033 | 21 | 29350581 | F | A | 116 | 1 | 145141386 | R | C | 117 |
| 2FH21F_01_034 | 21 | 29350590 | R | T | 116 | 1 | 145141395 | F | G | 117 |
| 2FH21F_01_036 | 21 | 29350625 | R | G | 119 | 1 | 145141431 | F | A | 120 |
| 2FH21F_01_037 | 21 | 29355542 | F | G | 93 | 1 | 145141768 | R | C | 106 |
| 2FH21F_01_038 | 21 | 29355550 | R | G | 96 | 1 | 145141789 | F | A | 109 |
| 2FH21F_01_039 | 21 | 29356359 | R | G | 90 | 1 | 145141960 | F | A | 90 |
| 2FH21F_01_040 | 21 | 29357621 | F | G | 87 | 1 | 145142269 | R | A | 87 |
| 2FH21F_01_041 | 21 | 29357656 | R | G | 120 | 1 | 145142304 | F | A | 120 |
| 2FH21F_01_043 | 21 | 29361150 | R | T | 91 | 1 | 145142637 | F | A | 91 |
| 2FH21F_01_044 | 21 | 29361182 | F | A | 106 | 1 | 145142669 | R | C | 106 |
| 2FH21F_01_045 | 21 | 29361209 | R | C | 106 | 1 | 145142696 | F | G | 106 |
| 2FH21F_01_046 | 21 | 29361246 | F | A | 109 | 1 | 145142733 | R | A | 109 |
| 2FH21F_01_049 | 21 | 31679773 | F | T | 120 | 1 | 9351912 | F | G | 134 |
| 2FH21F_01_050 | 21 | 31679795 | R | G | 120 | 1 | 9351890 | F | T | 134 |
| 2FH21F_01_057 | 21 | 33849236 | R | A | 86 | 1 | 155945466 | R | T | 86 |
| 2FH21F_01_058 | 21 | 33849456 | R | G | 109 | 1 | 155945581 | R | A | 109 |
| 2FH21F_01_059 | 21 | 33849485 | F | A | 113 | 1 | 155945610 | R | G | 113 |
| 2FH21F_01_060 | 21 | 33851363 | R | C | 116 | 1 | 155945724 | F | T | 116 |
| 2FH21F_01_062 | 21 | 33851411 | R | A | 96 | 1 | 155945772 | F | G | 96 |
| 2FH21F_01_063 | 21 | 33851469 | F | A | 105 | 1 | 155945830 | R | A | 105 |
| 2FH21F_01_064 | 21 | 33853810 | F | G | 96 | 1 | 155946048 | F | C | 96 |
| 2FH21F_01_065 | 21 | 33853850 | R | C | 85 | 1 | 155946088 | F | T | 85 |
| 2FH21F_01_067 | 21 | 33861377 | F | T | 92 | 1 | 155946234 | R | G | 92 |
| 2FH21F_01_068 | 21 | 33861410 | R | T | 112 | 1 | 155946267 | F | C | 112 |
| 2FH21F_01_071 | 21 | 33869988 | F | G | 113 | 1 | 155946671 | R | A | 113 |
| 2FH21F_01_072 | 21 | 33870000 | R | A | 104 | 1 | 155946683 | F | G | 104 |
| 2FH21F_01_073 | 21 | 33870731 | F | T | 103 | 1 | 155946943 | F | C | 103 |

TABLE 4A-continued

| | | | | | | | | | |
|---|---|---|---|---|---|---|---|---|---|
| 2FH21F_01_077 | 21 | 33870871 | R | A | 85 | 1 | 155947085 | R | G | 85 |
| 2FH21F_01_078 | 21 | 33870951 | F | C | 96 | 1 | 155947165 | F | T | 96 |
| 2FH21F_01_080 | 21 | 33871006 | R | C | 82 | 1 | 155947220 | R | T | 82 |
| 2FH21F_01_081 | 21 | 33871091 | R | G | 93 | 1 | 155947305 | R | C | 93 |
| 2FH21F_01_082 | 21 | 33871149 | R | A | 105 | 1 | 155947363 | F | G | 105 |
| 2FH21F_01_083 | 21 | 33871170 | F | A | 108 | 1 | 155947384 | F | C | 108 |
| 2FH21F_01_084 | 21 | 33871198 | F | A | 113 | 1 | 155947412 | F | C | 117 |
| 2FH21F_01_086 | 21 | 33871220 | R | C | 119 | 1 | 155947438 | R | A | 123 |
| 2FH21F_01_088 | 21 | 33871351 | F | C | 116 | 1 | 155947568 | F | G | 120 |
| 2FH21F_01_090 | 21 | 33871453 | F | G | 105 | 1 | 155947674 | F | A | 105 |
| 2FH21F_01_093 | 21 | 33871568 | R | A | 118 | 1 | 155947788 | R | G | 117 |
| 2FH21F_01_094 | 21 | 33871608 | F | C | 91 | 1 | 155947828 | F | T | 91 |
| 2FH21F_01_099 | 21 | 34436974 | F | C | 130 | 1 | 51085302 | F | C | 121 |
| 2FH21F_01_101 | 21 | 39590986 | F | C | 120 | 1 | 13755946 | F | A | 120 |
| 2FH21F_01_102 | 21 | 39591032 | R | G | 115 | 1 | 13755900 | R | A | 115 |
| 2FH21F_01_104 | 21 | 39591411 | F | C | 98 | 1 | 13755518 | F | C | 98 |
| 2FH21F_02_003 | 21 | 135535069 | F | A | 111 | 2 | 132391742 | F | A | 115 |
| 2FH21F_02_007 | 21 | 135543483 | F | C | 112 | 2 | 132383343 | F | C | 112 |
| 2FH21F_02_015 | 21 | 140091492 | F | A | 111 | 2 | 138411388 | F | G | 112 |
| 2FH21F_02_017 | 21 | 140091523 | F | C | 85 | 2 | 138411420 | F | T | 86 |
| 2FH21F_02_018 | 21 | 140091561 | F | T | 112 | 2 | 138411458 | F | A | 113 |
| 2FH21F_02_019 | 21 | 140091590 | R | G | 112 | 2 | 138411488 | R | A | 113 |
| 2FH21F_02_020 | 21 | 140091662 | F | A | 120 | 2 | 138411560 | F | G | 120 |
| 2FH21F_02_021 | 21 | 140091679 | R | T | 120 | 2 | 138411577 | R | C | 120 |
| 2FH21F_02_022 | 21 | 140091732 | F | T | 115 | 2 | 138411630 | F | C | 115 |
| 2FH21F_02_023 | 21 | 140091983 | F | T | 91 | 2 | 138411876 | F | A | 97 |
| 2FH21F_02_027 | 21 | 140092079 | F | T | 105 | 2 | 138411979 | F | G | 105 |
| 2FH21F_02_034 | 21 | 140092568 | R | T | 84 | 2 | 138412473 | R | C | 84 |
| 2FH21F_02_035 | 21 | 140092619 | R | A | 92 | 2 | 138412524 | R | C | 92 |
| 2FH21F_02_036 | 21 | 140092764 | R | C | 98 | 2 | 138412667 | R | A | 98 |
| 2FH21F_02_037 | 21 | 14380512 | F | C | 93 | 2 | 38777773 | F | C | 93 |
| 2FH21F_02_038 | 21 | 143902971 | F | T | 120 | 2 | 38790295 | F | C | 121 |
| 2FH21F_02_040 | 21 | 14396267 | F | C | 85 | 2 | 38796979 | F | T | 85 |
| 2FH21F_02_041 | 21 | 14437193 | F | T | 110 | 2 | 208014410 | F | C | 110 |
| 2FH21F_02_043 | 21 | 14437253 | F | T | 99 | 2 | 208014470 | F | T | 99 |
| 2FH21F_02_045 | 21 | 161498741 | R | A | 86 | 2 | 225225486 | R | C | 86 |
| 2FH21F_02_050 | 21 | 18127404 | R | T | 93 | 2 | 208185957 | R | A | 93 |
| 2FH21F_02_055 | 21 | 18128107 | F | T | 85 | 2 | 208185567 | F | G | 87 |
| 2FH21F_02_057 | 21 | 18433865 | F | C | 113 | 2 | 95536170 | F | A | 113 |
| 2FH21F_02_058 | 21 | 18433901 | R | A | 102 | 2 | 95536134 | R | A | 102 |
| 2FH21F_02_061 | 21 | 18434055 | R | C | 103 | 2 | 95535979 | R | C | 104 |
| 2FH21F_02_062 | 21 | 18434167 | F | G | 113 | 2 | 95535867 | F | C | 114 |
| 2FH21F_02_063 | 21 | 18434195 | F | T | 113 | 2 | 95535838 | F | T | 114 |
| 2FH21F_02_065 | 21 | 18434275 | F | T | 110 | 2 | 95535758 | F | A | 110 |
| 2FH21F_02_066 | 21 | 18434542 | F | T | 82 | 2 | 95536686 | F | T | 82 |
| 2FH21F_02_067 | 21 | 18434573 | R | A | 99 | 2 | 95536717 | R | T | 99 |
| 2FH21F_02_072 | 21 | 18435016 | R | G | 94 | 2 | 95537160 | R | A | 94 |
| 2FH21F_02_073 | 21 | 18435097 | F | A | 111 | 2 | 95537238 | F | A | 108 |
| 2FH21F_02_074 | 21 | 20848805 | F | A | 102 | 2 | 33521214 | F | T | 102 |
| 2FH21F_02_075 | 21 | 20848810 | F | A | 97 | 2 | 33521219 | F | T | 97 |
| 2FH21F_02_076 | 21 | 20848832 | F | C | 96 | 2 | 33521241 | F | A | 96 |
| 2FH21F_02_077 | 21 | 20848339 | R | G | 101 | 2 | 33521248 | R | A | 101 |
| 2FH21F_02_088 | 21 | 28215571 | F | G | 99 | 2 | 132405073 | F | A | 99 |

TABLE 4A-continued

| | | | | | | | | | |
|---|---|---|---|---|---|---|---|---|---|
| 2FH21F_02_089 | 21 | 282215882 | R | T | 95 | 2 | 132404762 | F | 95 |
| 2FH21F_02_090 | 21 | 282215945 | R | C | 102 | 2 | 132404699 | F | 102 |
| 2FH21F_02_091 | 21 | 282215990 | F | C | 116 | 2 | 132404654 | R | 117 |
| 2FH21F_02_103 | 21 | 282234536 | R | A | 92 | 2 | 132386044 | F | 95 |
| 2FH21F_02_107 | 21 | 282264424 | R | A | 112 | 2 | 132366224 | F | 112 |
| 2FH21F_02_108 | 21 | 282264470 | F | G | 111 | 2 | 132366178 | R | 116 |
| 2FH21F_02_111 | 21 | 282264552 | F | A | 85 | 2 | 132366091 | R | 85 |
| 2FH21F_02_113 | 21 | 282264816 | R | T | 116 | 2 | 132365833 | F | 116 |
| 2FH21F_02_116 | 21 | 282278126 | R | C | 119 | 2 | 132352487 | R | 118 |
| 2FH21F_02_127 | 21 | 315597156 | F | C | 86 | 2 | 231393191 | R | 86 |
| 2FH21F_02_129 | 21 | 315597201 | F | G | 85 | 2 | 231393146 | R | 85 |
| 2FH21F_02_132 | 21 | 315597387 | F | G | 94 | 2 | 231392961 | R | 94 |
| 2FH21F_02_134 | 21 | 315597421 | F | C | 81 | 2 | 231392927 | R | 86 |
| 2FH21F_02_139 | 21 | 315597560 | R | G | 116 | 2 | 231392784 | F | 116 |
| 2FH21F_02_143 | 21 | 328333444 | F | A | 93 | 2 | 286903 | R | 93 |
| 2FH21F_02_144 | 21 | 328333448 | F | C | 93 | 2 | 286899 | R | 93 |
| 2FH21F_02_145 | 21 | 328333749 | F | T | 90 | 2 | 286607 | F | 90 |
| 2FH21F_02_146 | 21 | 328334036 | R | G | 120 | 2 | 286312 | R | 120 |
| 2FH21F_02_148 | 21 | 341977714 | R | T | 118 | 2 | 206809213 | F | 118 |
| 2FH21F_02_150 | 21 | 361833313 | F | C | 120 | 2 | 106922404 | R | 119 |
| 2FH21F_02_151 | 21 | 364243390 | R | A | 101 | 2 | 32089093 | A | 101 |
| 2FH21F_02_155 | 21 | 437014082 | R | G | 115 | 2 | 112908101 | F | 114 |
| 2FH21F_02_156 | 21 | 437015020 | F | T | 115 | 2 | 112908195 | R | 115 |
| 2FH21F_02_157 | 21 | 437015208 | F | C | 96 | 2 | 112908213 | R | 96 |
| 2FH21F_02_158 | 21 | 437015580 | F | C | 86 | 2 | 112908251 | R | 89 |
| 2FH21F_02_159 | 21 | 437015610 | R | T | 81 | 2 | 112908257 | F | 84 |
| 2FH21F_02_163 | 21 | 437017560 | R | G | 96 | 2 | 112908452 | F | 96 |
| 2FH21F_02_168 | 21 | 437023180 | R | A | 101 | 2 | 112909018 | F | 101 |
| 2FH21F_02_170 | 21 | 437025120 | F | A | 103 | 2 | 112909212 | R | 103 |
| 2FH21F_02_172 | 21 | 437026100 | R | T | 109 | 2 | 112909310 | F | 109 |
| 2FH21F_02_173 | 21 | 437026450 | F | T | 115 | 2 | 112909345 | R | 115 |
| 2FH21F_02_174 | 21 | 437027400 | F | A | 117 | 2 | 112909440 | R | 117 |
| 2FH21F_02_175 | 21 | 437027820 | R | C | 96 | 2 | 112909482 | F | 96 |
| 2FH21F_02_177 | 21 | 437028890 | R | T | 112 | 2 | 112909589 | F | 112 |
| 2FH21F_02_178 | 21 | 437029100 | F | A | 115 | 2 | 112909610 | R | 115 |
| 2FH21F_02_181 | 21 | 437029890 | F | A | 100 | 2 | 112909689 | R | 101 |
| 2FH21F_02_182 | 21 | 437030080 | R | C | 99 | 2 | 112909709 | F | 100 |
| 2FH21F_02_184 | 21 | 437032020 | R | C | 108 | 2 | 112909903 | F | 108 |
| 2FH21F_02_185 | 21 | 437032250 | F | C | 108 | 2 | 112909926 | R | 108 |
| 2FH21F_02_189 | 21 | 437040430 | F | G | 104 | 2 | 112910745 | R | 104 |
| 2FH21F_02_190 | 21 | 437041530 | R | A | 117 | 2 | 112910855 | F | 117 |
| 2FH21F_02_191 | 21 | 437042430 | R | C | 105 | 2 | 112910945 | F | 105 |
| 2FH21F_02_193 | 21 | 437045080 | F | C | 108 | 2 | 112911210 | R | 108 |
| 2FH21F_02_194 | 21 | 437045390 | F | C | 107 | 2 | 112911241 | R | 107 |
| 2FH21F_02_195 | 21 | 437046010 | F | T | 111 | 2 | 112911303 | R | 111 |
| 2FH21F_02_200 | 21 | 437048900 | F | T | 118 | 2 | 112911592 | R | 118 |
| 2FH21F_02_204 | 21 | 449199780 | F | A | 108 | 2 | 86224659 | F | 109 |
| 2FH21F_02_206 | 21 | 449201130 | R | A | 118 | 2 | 86224795 | R | 118 |
| 2FH21F_02_207 | 21 | 449202840 | F | G | 89 | 2 | 86224967 | R | 89 |
| 2FH21F_02_208 | 21 | 449203300 | F | C | 107 | 2 | 86225013 | R | 107 |
| 2FH21F_02_211 | 21 | 449203790 | R | A | 119 | 2 | 86225062 | R | 119 |
| 2FH21F_02_212 | 21 | 449205440 | R | A | 90 | 2 | 86225231 | R | 90 |
| 2FH21F_02_213 | 21 | 449205870 | F | A | 88 | 2 | 86225274 | F | 88 |

TABLE 4A-continued

| | | | | | | | | | |
|---|---|---|---|---|---|---|---|---|---|
| 2FH21F_02_214 | 21 | 44920594 | R | A | 94 | 2 | 86225281 | G | 94 |
| 2FH21F_02_215 | 21 | 44920624 | F | T | 108 | 2 | 86225311 | F | 108 |
| 2FH21F_02_216 | 21 | 44920652 | F | T | 118 | 2 | 86225339 | F | 118 |
| 2FH21F_02_217 | 21 | 44920732 | R | A | 92 | 2 | 86225419 | R | 92 |
| 2FH21F_02_218 | 21 | 44920793 | R | A | 81 | 2 | 86225480 | R | 81 |
| 2FH21F_02_219 | 21 | 44921280 | F | C | 91 | 2 | 86232120 | G | 91 |
| 2FH21F_02_220 | 21 | 44921506 | F | T | 87 | 2 | 86240216 | G | 103 |
| 2FH21F_02_223 | 21 | 44921778 | R | T | 110 | 2 | 86247236 | C | 110 |
| 2FH21F_02_226 | 21 | 44922084 | R | G | 94 | 2 | 86254352 | A | 94 |
| 2FH21F_02_227 | 21 | 44922157 | F | G | 84 | 2 | 86260096 | C | 84 |
| 2FH21F_02_228 | 21 | 44922175 | R | C | 92 | 2 | 86260114 | T | 92 |
| 2FH21F_02_230 | 21 | 44917919 | R | A | 87 | 2 | 92420 | A | 87 |
| 2FH21F_02_232 | 21 | 46918360 | R | A | 92 | 2 | 91979 | C | 92 |
| 2FH21F_02_234 | 21 | 46918645 | F | A | 115 | 2 | 91692 | C | 115 |
| 2FH21F_02_235 | 21 | 46918651 | F | T | 112 | 2 | 91686 | C | 112 |
| 2FH21F_02_236 | 21 | 46918748 | R | G | 107 | 2 | 91589 | T | 107 |
| 2FH21F_02_239 | 21 | 46918867 | F | C | 85 | 2 | 91470 | T | 85 |
| 2FH21F_02_241 | 21 | 46919142 | F | T | 113 | 2 | 91213 | G | 113 |
| 2FH21F_02_243 | 21 | 46919207 | R | G | 95 | 2 | 91147 | C | 95 |
| 2FH21F_02_248 | 21 | 46920267 | R | T | 92 | 2 | 90118 | C | 95 |
| 2FH21F_02_249 | 21 | 46920298 | F | C | 86 | 2 | 90087 | T | 86 |
| 2FH21F_02_250 | 21 | 46920352 | R | A | 98 | 2 | 90033 | G | 98 |
| 2FH21F_02_254 | 21 | 46920612 | F | T | 95 | 2 | 89503 | C | 95 |
| 2FH21F_03_005 | 21 | 15894129 | R | C | 121 | 3 | 50774887 | G | 119 |
| 2FH21F_03_007 | 21 | 15894317 | F | G | 95 | 3 | 50774127 | F | 97 |
| 2FH21F_03_008 | 21 | 15894382 | F | G | 108 | 3 | 50774062 | F | 108 |
| 2FH21F_03_011 | 21 | 15894444 | F | T | 102 | 3 | 50774000 | T | 102 |
| 2FH21F_03_012 | 21 | 15894451 | R | T | 99 | 3 | 50773993 | G | 99 |
| 2FH21F_03_013 | 21 | 15894476 | F | C | 99 | 3 | 50773968 | T | 99 |
| 2FH21F_03_014 | 21 | 15894647 | R | G | 113 | 3 | 50773797 | T | 113 |
| 2FH21F_03_015 | 21 | 15894746 | F | T | 120 | 3 | 50773698 | G | 120 |
| 2FH21F_03_017 | 21 | 18755793 | R | T | 120 | 3 | 107588227 | C | 120 |
| 2FH21F_03_018 | 21 | 18755822 | F | T | 120 | 3 | 107588256 | C | 120 |
| 2FH21F_03_021 | 21 | 18756063 | R | A | 95 | 3 | 107588491 | G | 95 |
| 2FH21F_03_022 | 21 | 18756109 | F | C | 91 | 3 | 107588537 | T | 91 |
| 2FH21F_03_025 | 21 | 19539204 | R | A | 109 | 3 | 14464204 | T | 109 |
| 2FH21F_03_026 | 21 | 19539233 | F | G | 103 | 3 | 14464233 | T | 103 |
| 2FH21F_03_027 | 21 | 19539238 | F | C | 98 | 3 | 14464238 | A | 98 |
| 2FH21F_03_028 | 21 | 19539267 | F | G | 106 | 3 | 14464267 | A | 106 |
| 2FH21F_03_030 | 21 | 19775552 | F | G | 89 | 3 | 14950732 | A | 89 |
| 2FH21F_03_031 | 21 | 19775569 | F | A | 83 | 3 | 14950715 | A | 83 |
| 2FH21F_03_039 | 21 | 25654993 | R | C | 100 | 3 | 116610381 | C | 100 |
| 2FH21F_03_040 | 21 | 25655024 | R | U | 95 | 3 | 116610412 | T | 95 |
| 2FH21F_03_043 | 21 | 27438037 | F | C | 81 | 3 | 49370600 | A | 81 |
| 2FH21F_03_053 | 21 | 32740757 | F | A | 86 | 3 | 131271948 | A | 86 |
| 2FH21F_03_058 | 21 | 33872005 | R | T | 113 | 3 | 137256165 | A | 113 |
| 2FH21F_03_061 | 21 | 33872582 | F | G | 101 | 3 | 137257230 | C | 101 |
| 2FH21F_03_062 | 21 | 33873563 | F | A | 94 | 3 | 137257154 | G | 94 |
| 2FH21F_03_063 | 21 | 33873613 | R | T | 101 | 3 | 137257104 | C | 101 |
| 2FH21F_03_064 | 21 | 33873616 | F | A | 101 | 3 | 137257101 | T | 101 |
| 2FH21F_03_065 | 21 | 33873672 | R | G | 100 | 3 | 137257045 | C | 100 |
| 2FH21F_03_071 | 21 | 39487857 | R | T | 97 | 3 | 6496443 | C | 97 |
| 2FH21F_03_073 | 21 | 39487887 | R | G | 98 | 3 | 6496473 | A | 98 |

TABLE 4A-continued

| | | | | | | | | | |
|---|---|---|---|---|---|---|---|---|---|
| 2FH21F_03_079 | 21 | 39488200 | R | A | 94 | 3 | 6496780 | R | G | 94 |
| 2FH21F_03_080 | 21 | 39488320 | F | G | 101 | 3 | 6496902 | F | A | 102 |
| 2FH21F_03_081 | 21 | 39488330 | R | T | 100 | 3 | 6496912 | R | C | 101 |
| 2FH21F_03_083 | 21 | 39488395 | F | C | 119 | 3 | 6496978 | F | T | 119 |
| 2FH21F_03_084 | 21 | 39488417 | F | A | 119 | 3 | 6497000 | F | G | 119 |
| 2FH21F_03_085 | 21 | 39488427 | R | T | 118 | 3 | 6497010 | R | C | 118 |
| 2FH21F_03_087 | 21 | 39488728 | F | C | 108 | 3 | 6497201 | F | T | 108 |
| 2FH21F_03_088 | 21 | 39488868 | F | C | 119 | 3 | 6497341 | F | G | 119 |
| 2FH21F_03_089 | 21 | 39488934 | R | A | 120 | 3 | 6497407 | R | G | 119 |
| 2FH21F_03_091 | 21 | 39488983 | F | G | 118 | 3 | 6497455 | F | A | 117 |
| 2FH21F_03_093 | 21 | 39489193 | R | A | 109 | 3 | 6497664 | R | G | 109 |
| 2FH21F_03_094 | 21 | 39489227 | F | A | 105 | 3 | 6497698 | F | G | 106 |
| 2FH21F_03_095 | 21 | 39489346 | F | C | 106 | 3 | 6497817 | F | T | 105 |
| 2FH21F_03_097 | 21 | 40695570 | F | C | 116 | 3 | 141989208 | F | A | 121 |
| 2FH21F_03_100 | 21 | 40695618 | R | T | 120 | 3 | 141989261 | R | G | 125 |
| 2FH21F_03_101 | 21 | 40695660 | R | G | 106 | 3 | 141989303 | R | G | 106 |
| 2FH21F_04_006 | 21 | 40695692 | F | A | 106 | 3 | 141989335 | F | A | 106 |
| 2FH21F_04_008 | 21 | 17963704 | F | A | 80 | 4 | 94858511 | R | G | 80 |
| 2FH21F_04_010 | 21 | 223952232 | F | G | 119 | 4 | 110832709 | R | G | 115 |
| 2FH21F_04_011 | 21 | 23867805 | R | G | 106 | 4 | 83204416 | F | A | 107 |
| 2FH21F_04_014 | 21 | 23867842 | F | G | 107 | 4 | 83204454 | R | T | 108 |
| 2FH21F_04_015 | 21 | 31962966 | R | G | 85 | 4 | 164801285 | F | A | 85 |
| 2FH21F_04_017 | 21 | 31962996 | F | T | 93 | 4 | 164801315 | R | C | 92 |
| 2FH21F_04_018 | 21 | 33092540 | F | T | 98 | 4 | 185473899 | R | G | 98 |
| 2FH21F_04_019 | 21 | 33092610 | F | T | 115 | 4 | 185473829 | R | G | 115 |
| 2FH21F_04_021 | 21 | 33092642 | R | G | 119 | 4 | 185473797 | F | G | 119 |
| 2FH21F_04_022 | 21 | 33092683 | R | T | 111 | 4 | 185473756 | F | A | 111 |
| 2FH21F_04_023 | 21 | 33092713 | F | C | 100 | 4 | 185473726 | R | G | 100 |
| 2FH21F_04_024 | 21 | 44291397 | R | G | 92 | 4 | 101090391 | F | A | 92 |
| 2FH21F_05_003 | 21 | 44291416 | F | C | 93 | 4 | 101090410 | R | T | 93 |
| 2FH21F_05_005 | 21 | 158112473 | F | C | 114 | 5 | 157490943 | R | C | 114 |
| 2FH21F_05_006 | 21 | 158112543 | F | T | 101 | 5 | 157490873 | R | G | 101 |
| 2FH21F_05_007 | 21 | 18426542 | R | A | 93 | 5 | 160998928 | F | A | 91 |
| 2FH21F_05_008 | 21 | 18426561 | F | T | 99 | 5 | 160998911 | R | C | 97 |
| 2FH21F_05_013 | 21 | 18426592 | F | A | 87 | 5 | 160998880 | R | A | 87 |
| 2FH21F_05_015 | 21 | 18426958 | F | A | 89 | 5 | 160998513 | R | C | 88 |
| 2FH21F_05_016 | 21 | 18427206 | F | A | 115 | 5 | 160998262 | R | C | 115 |
| 2FH21F_05_018 | 21 | 18427235 | F | T | 97 | 5 | 160998233 | R | G | 97 |
| 2FH21F_05_019 | 21 | 20033996 | F | A | 99 | 5 | 64072748 | R | G | 99 |
| 2FH21F_05_025 | 21 | 20034055 | F | A | 104 | 5 | 64072689 | R | G | 104 |
| 2FH21F_05_026 | 21 | 270040842 | R | T | 105 | 5 | 35308795 | F | A | 105 |
| 2FH21F_05_027 | 21 | 270040864 | F | A | 105 | 5 | 35308773 | R | T | 105 |
| 2FH21F_05_028 | 21 | 31316723 | R | T | 111 | 5 | 23151508 | F | C | 111 |
| 2FH21F_05_032 | 21 | 31316765 | F | T | 114 | 5 | 23151550 | R | T | 114 |
| 2FH21F_05_033 | 21 | 31918345 | F | A | 118 | 5 | 171221502 | R | A | 118 |
| 2FH21F_05_034 | 21 | 31918387 | R | T | 95 | 5 | 171221544 | F | A | 94 |
| 2FH21F_05_035 | 21 | 31918647 | F | A | 108 | 5 | 171221804 | R | A | 108 |
| 2FH21F_05_040 | 21 | 31918687 | R | T | 83 | 5 | 171221844 | F | C | 83 |
| 2FH21F_05_041 | 21 | 31918896 | F | C | 119 | 5 | 171222065 | R | T | 118 |
| 2FH21F_05_044 | 21 | 31918920 | R | C | 91 | 5 | 171222089 | F | T | 91 |
| 2FH21F_05_045 | 21 | 31919409 | F | G | 82 | 5 | 171222232 | R | A | 82 |
| 2FH21F_05_047 | 21 | 31919418 | R | G | 82 | 5 | 171222241 | F | A | 82 |
| 2FH21F_05_047 | 21 | 31919498 | R | G | 118 | 5 | 171222321 | R | C | 118 |

TABLE 4A-continued

| ID | chr | position | str | allele | num | position2 | str2 | allele2 | num2 |
|---|---|---|---|---|---|---|---|---|---|
| 2FH21F_05_051 | 21 | 31919696 | R | A | 112 | 171222519 | R | C | 112 |
| 2FH21F_05_054 | 21 | 31919824 | F | T | 90 | 171222647 | F | A | 91 |
| 2FH21F_05_058 | 21 | 31920049 | R | C | 104 | 171222880 | R | T | 104 |
| 2FH21F_05_061 | 21 | 31920141 | F | T | 81 | 171222972 | F | C | 81 |
| 2FH21F_05_064 | 21 | 31920848 | R | T | 101 | 171223266 | R | C | 101 |
| 2FH21F_05_066 | 21 | 31920882 | R | A | 102 | 171223300 | R | C | 102 |
| 2FH21F_05_067 | 21 | 31920932 | F | G | 99 | 171223350 | F | G | 99 |
| 2FH21F_05_069 | 21 | 31920989 | R | A | 112 | 171223408 | R | A | 113 |
| 2FH21F_05_072 | 21 | 31921065 | F | A | 116 | 171223484 | F | G | 115 |
| 2FH21F_05_073 | 21 | 31921138 | R | T | 100 | 171223556 | R | G | 100 |
| 2FH21F_05_074 | 21 | 31921163 | R | G | 103 | 171223581 | R | C | 103 |
| 2FH21F_05_076 | 21 | 31921354 | F | T | 101 | 171228281 | F | T | 101 |
| 2FH21F_05_080 | 21 | 31921952 | F | C | 113 | 171236063 | F | T | 113 |
| 2FH21F_05_083 | 21 | 31922417 | R | T | 84 | 171259565 | R | C | 84 |
| 2FH21F_05_088 | 21 | 31922614 | F | G | 94 | 171270233 | F | A | 94 |
| 2FH21F_05_091 | 21 | 31921769 | R | G | 83 | 10718223 | R | G | 83 |
| 2FH21F_05_092 | 21 | 34117723 | F | T | 106 | 10718185 | F | T | 105 |
| 2FH21F_05_094 | 21 | 34117762 | R | C | 111 | 10718152 | R | C | 110 |
| 2FH21F_05_096 | 21 | 34130664 | F | C | 92 | 10717750 | F | A | 92 |
| 2FH21F_05_097 | 21 | 34130701 | F | T | 98 | 10717713 | F | G | 98 |
| 2FH21F_05_098 | 21 | 34130721 | R | T | 99 | 10717693 | R | C | 99 |
| 2FH21F_05_099 | 21 | 34131201 | F | A | 91 | 10717567 | F | A | 91 |
| 2FH21F_05_101 | 21 | 34131361 | R | C | 104 | 10717407 | R | T | 104 |
| 2FH21F_05_102 | 21 | 34131411 | F | C | 110 | 10717357 | F | A | 110 |
| 2FH21F_05_109 | 21 | 39372630 | R | G | 82 | 21021038 | R | T | 82 |
| 2FH21F_05_110 | 21 | 39372638 | F | C | 80 | 21021030 | F | C | 80 |
| 2FH21F_06_001 | 21 | 17888275 | F | C | 81 | 139639257 | F | G | 79 |
| 2FH21F_06_004 | 21 | 26521837 | F | A | 98 | 114291260 | F | A | 98 |
| 2FH21F_06_005 | 21 | 26521929 | R | G | 110 | 114291168 | R | T | 110 |
| 2FH21F_06_006 | 21 | 26521974 | F | C | 91 | 114291124 | F | A | 90 |
| 2FH21F_06_007 | 21 | 26522028 | F | C | 89 | 114291070 | F | A | 89 |
| 2FH21F_06_011 | 21 | 26527970 | R | C | 116 | 114290746 | R | T | 117 |
| 2FH21F_06_012 | 21 | 26528056 | R | G | 101 | 114290660 | R | A | 101 |
| 2FH21F_06_013 | 21 | 26528063 | R | T | 82 | 114290653 | R | T | 82 |
| 2FH21F_06_015 | 21 | 26528520 | F | G | 117 | 114290188 | F | C | 117 |
| 2FH21F_06_023 | 21 | 26528680 | F | G | 95 | 114290028 | F | T | 95 |
| 2FH21F_06_025 | 21 | 26528889 | F | A | 111 | 114289819 | F | T | 111 |
| 2FH21F_06_026 | 21 | 26528957 | F | A | 118 | 114289751 | F | A | 118 |
| 2FH21F_06_028 | 21 | 26529017 | R | T | 118 | 114289691 | R | A | 119 |
| 2FH21F_06_029 | 21 | 26529096 | R | T | 97 | 114289611 | R | C | 97 |
| 2FH21F_06_031 | 21 | 26529157 | R | G | 118 | 114289550 | R | T | 118 |
| 2FH21F_06_034 | 21 | 26529316 | F | G | 104 | 114289392 | F | T | 105 |
| 2FH21F_06_035 | 21 | 26529525 | F | C | 94 | 114289182 | F | T | 94 |
| 2FH21F_06_037 | 21 | 26529569 | R | C | 105 | 114289138 | R | C | 105 |
| 2FH21F_06_045 | 21 | 26529646 | R | A | 119 | 114289061 | R | T | 120 |
| 2FH21F_06_033 | 21 | 26529744 | R | T | 94 | 114288954 | R | T | 102 |
| 2FH21F_06_046 | 21 | 29875665 | R | A | 86 | 102479244 | R | G | 86 |
| 2FH21F_06_047 | 21 | 29875668 | F | A | 86 | 102479241 | F | C | 86 |
| 2FH21F_06_028 | 21 | 30050650 | R | C | 112 | 6413565 | R | A | 112 |
| 2FH21F_06_051 | 21 | 31747020 | F | G | 86 | 154912719 | F | T | 85 |
| 2FH21F_06_052 | 21 | 31747021 | F | A | 101 | 107468032 | F | G | 101 |
| 2FH21F_06_053 | 21 | 31747168 | F | G | 116 | 154912866 | F | T | 116 |
| 2FH21F_06_060 | 21 | 32835972 | R | A | 117 | 156609546 | R | T | 116 |

TABLE 4A-continued

| ID | | | | | | | | | | | |
|---|---|---|---|---|---|---|---|---|---|---|---|
| 2FH21F_06_061 | 21 | 32835996 | F | T | 111 | 6 | 156609570 | F | C | 110 |
| 2FH21F_06_062 | 21 | 32836018 | R | A | 94 | 6 | 156609591 | R | T | 93 |
| 2FH21F_06_064 | 21 | 32836229 | F | A | 108 | 6 | 156609801 | F | G | 111 |
| 2FH21F_06_065 | 21 | 32836400 | F | G | 92 | 6 | 156609975 | F | C | 92 |
| 2FH21F_06_068 | 21 | 32836499 | R | A | 116 | 6 | 156610074 | R | G | 116 |
| 2FH21F_06_073 | 21 | 32836931 | R | G | 95 | 6 | 156610505 | R | A | 95 |
| 2FH21F_06_075 | 21 | 32837154 | F | T | 106 | 6 | 156610726 | F | A | 106 |
| 2FH21F_06_076 | 21 | 32837191 | R | G | 113 | 6 | 156610763 | R | C | 113 |
| 2FH21F_06_077 | 21 | 32837231 | F | C | 86 | 6 | 156610803 | F | T | 86 |
| 2FH21F_06_079 | 21 | 32837258 | R | C | 107 | 6 | 156610830 | R | A | 107 |
| 2FH21F_06_082 | 21 | 32838067 | F | A | 90 | 6 | 156611192 | F | G | 89 |
| 2FH21F_06_083 | 21 | 32838110 | F | G | 87 | 6 | 156611234 | F | T | 87 |
| 2FH21F_06_084 | 21 | 32838463 | F | G | 84 | 6 | 156611587 | F | A | 84 |
| 2FH21F_06_088 | 21 | 32838640 | F | C | 82 | 6 | 156611764 | F | T | 82 |
| 2FH21F_06_092 | 21 | 32838763 | R | G | 88 | 6 | 156611887 | R | C | 88 |
| 2FH21F_06_093 | 21 | 32838962 | F | C | 97 | 6 | 156612095 | F | G | 97 |
| 2FH21F_06_095 | 21 | 32839594 | F | G | 94 | 6 | 156612730 | F | A | 97 |
| 2FH21F_06_099 | 21 | 32839825 | R | G | 89 | 6 | 156612965 | R | T | 89 |
| 2FH21F_06_102 | 21 | 32839931 | F | T | 108 | 6 | 156613068 | F | C | 108 |
| 2FH21F_06_107 | 21 | 32840060 | F | T | 116 | 6 | 156613197 | F | T | 116 |
| 2FH21F_06_110 | 21 | 32840630 | R | G | 105 | 6 | 156613770 | R | C | 108 |
| 2FH21F_06_111 | 21 | 32840668 | F | G | 118 | 6 | 156613808 | F | C | 121 |
| 2FH21F_06_112 | 21 | 32840695 | R | T | 112 | 6 | 156613838 | R | A | 119 |
| 2FH21F_06_113 | 21 | 32840740 | F | G | 120 | 6 | 156613883 | F | G | 96 |
| 2FH21F_06_114 | 21 | 32840770 | R | A | 97 | 6 | 156613912 | R | A | 107 |
| 2FH21F_06_117 | 21 | 32840889 | F | G | 111 | 6 | 156614032 | F | C | 108 |
| 2FH21F_06_118 | 21 | 32840915 | R | A | 112 | 6 | 156614054 | R | A | 95 |
| 2FH21F_06_119 | 21 | 32841051 | R | C | 95 | 6 | 156614190 | R | T | 91 |
| 2FH21F_06_127 | 21 | 32844567 | F | T | 91 | 6 | 156617501 | F | C | 120 |
| 2FH21F_06_128 | 21 | 32844629 | R | C | 120 | 6 | 156617563 | R | T | 120 |
| 2FH21F_06_129 | 21 | 32844655 | R | G | 120 | 6 | 156617589 | R | A | 119 |
| 2FH21F_06_130 | 21 | 32844700 | F | T | 119 | 6 | 156617634 | F | C | 96 |
| 2FH21F_06_132 | 21 | 32844750 | R | G | 96 | 6 | 156617684 | R | C | 117 |
| 2FH21F_06_133 | 21 | 32844772 | F | G | 117 | 6 | 156617706 | F | A | 120 |
| 2FH21F_06_134 | 21 | 32844793 | R | A | 120 | 6 | 156617727 | R | T | 120 |
| 2FH21F_06_135 | 21 | 32844826 | R | T | 103 | 6 | 156617760 | R | G | 103 |
| 2FH21F_06_137 | 21 | 32844977 | F | T | 113 | 6 | 156617917 | F | C | 114 |
| 2FH21F_06_138 | 21 | 32845021 | F | T | 114 | 6 | 156617961 | F | C | 113 |
| 2FH21F_06_140 | 21 | 32845086 | R | A | 102 | 6 | 156618025 | R | C | 102 |
| 2FH21F_06_141 | 21 | 32845096 | R | C | 85 | 6 | 156618035 | R | C | 85 |
| 2FH21F_06_142 | 21 | 32845163 | F | T | 104 | 6 | 156618102 | F | C | 104 |
| 2FH21F_06_144 | 21 | 32845265 | F | T | 105 | 6 | 156618204 | F | C | 105 |
| 2FH21F_06_147 | 21 | 32845497 | R | G | 103 | 6 | 156618436 | R | A | 103 |
| 2FH21F_06_148 | 21 | 32845501 | F | C | 103 | 6 | 156618440 | F | A | 103 |
| 2FH21F_06_149 | 21 | 32845574 | F | C | 118 | 6 | 156618513 | F | T | 118 |
| 2FH21F_06_150 | 21 | 32845973 | R | T | 112 | 6 | 156618922 | R | T | 112 |
| 2FH21F_06_153 | 21 | 32846019 | R | T | 102 | 6 | 156618968 | R | T | 102 |
| 2FH21F_06_155 | 21 | 32846052 | F | G | 108 | 6 | 156619001 | F | C | 108 |
| 2FH21F_06_156 | 21 | 32846079 | R | C | 109 | 6 | 156619028 | R | C | 116 |
| 2FH21F_06_159 | 21 | 32846617 | F | T | 87 | 6 | 156619266 | F | G | 87 |
| 2FH21F_06_163 | 21 | 32849012 | R | T | 99 | 6 | 156621662 | R | C | 99 |
| 2FH21F_06_165 | 21 | 32849060 | R | A | 93 | 6 | 156621710 | R | G | 93 |
| 2FH21F_06_166 | 21 | 32849104 | F | C | 120 | 6 | 156621754 | F | T | 119 |

TABLE 4A-continued

| | | | | | | | | |
|---|---|---|---|---|---|---|---|---|
| 2FH21F_06_168 | 21 | 32849148 | F | 113 | 6 | 156621797 | F | A | 112 |
| 2FH21F_06_172 | 21 | 32849578 | F | 112 | 6 | 156622258 | F | C | 113 |
| 2FH21F_06_176 | 21 | 32849896 | F | 111 | 6 | 156622572 | F | T | 110 |
| 2FH21F_06_179 | 21 | 32850613 | R | 103 | 6 | 156622980 | R | A | 107 |
| 2FH21F_06_182 | 21 | 32850954 | F | 118 | 6 | 156625339 | F | C | 118 |
| 2FH21F_06_183 | 21 | 32850996 | F | 113 | 6 | 156625297 | F | C | 113 |
| 2FH21F_06_194 | 21 | 32863500 | F | 102 | 6 | 161178437 | F | A | 102 |
| 2FH21F_06_196 | 21 | 32863965 | R | 112 | 6 | 167684833 | R | G | 127 |
| 2FH21F_06_198 | 21 | 32864171 | R | 115 | 6 | 167685060 | R | T | 114 |
| 2FH21F_06_204 | 21 | 32867314 | R | 102 | 6 | 167521102 | F | T | 102 |
| 2FH21F_06_213 | 21 | 32883453 | F | 100 | 6 | 167724992 | F | A | 100 |
| 2FH21F_06_219 | 21 | 32883480 | F | 93 | 6 | 167725019 | F | C | 93 |
| 2FH21F_06_224 | 21 | 32885410 | R | 107 | 6 | 167728703 | R | A | 107 |
| 2FH21F_06_228 | 21 | 32885661 | R | 88 | 6 | 167728958 | R | C | 90 |
| 2FH21F_06_229 | 21 | 32885700 | F | 118 | 6 | 167728997 | F | C | 142 |
| 2FH21F_06_233 | 21 | 32886101 | F | 99 | 6 | 167729422 | F | G | 99 |
| 2FH21F_06_238 | 21 | 32886328 | R | 115 | 6 | 167729649 | R | G | 115 |
| 2FH21F_06_239 | 21 | 32886535 | F | 116 | 6 | 167729855 | F | G | 116 |
| 2FH21F_06_241 | 21 | 32886578 | R | 116 | 6 | 167729898 | R | A | 116 |
| 2FH21F_06_242 | 21 | 32888205 | R | 108 | 6 | 167732826 | F | C | 108 |
| 2FH21F_06_243 | 21 | 32888229 | R | 108 | 6 | 167732850 | R | C | 108 |
| 2FH21F_06_250 | 21 | 32889347 | F | 120 | 6 | 167733959 | F | C | 119 |
| 2FH21F_06_251 | 21 | 32889391 | F | 119 | 6 | 167734003 | F | T | 119 |
| 2FH21F_06_252 | 21 | 32889422 | R | 114 | 6 | 167734034 | R | G | 114 |
| 2FH21F_06_253 | 21 | 32889464 | F | 113 | 6 | 167734076 | F | G | 113 |
| 2FH21F_06_254 | 21 | 32889504 | R | 85 | 6 | 167734116 | R | G | 85 |
| 2FH21F_06_258 | 21 | 32889591 | R | 124 | 6 | 167734195 | R | C | 116 |
| 2FH21F_06_259 | 21 | 32889621 | F | 103 | 6 | 167734225 | F | C | 103 |
| 2FH21F_06_263 | 21 | 34679715 | F | 119 | 6 | 86502282 | R | A | 119 |
| 2FH21F_06_264 | 21 | 34679765 | R | 115 | 6 | 86502232 | F | C | 115 |
| 2FH21F_06_268 | 21 | 36424803 | R | 107 | 6 | 135260845 | R | A | 107 |
| 2FH21F_06_277 | 21 | 36680355 | R | 103 | 6 | 106220938 | R | T | 103 |
| 2FH21F_06_278 | 21 | 36707214 | F | 111 | 6 | 106222106 | F | C | 111 |
| 2FH21F_06_279 | 21 | 36707282 | F | 84 | 6 | 106222174 | F | A | 84 |
| 2FH21F_06_284 | 21 | 36707299 | R | 93 | 6 | 106222191 | R | A | 93 |
| 2FH21F_06_288 | 21 | 36710882 | R | 93 | 6 | 106222912 | R | A | 94 |
| 2FH21F_07_002 | 21 | 44005258 | R | 96 | 7 | 14831246 | R | T | 96 |
| 2FH21F_07_003 | 21 | 100017549 | F | 81 | 7 | 151532773 | F | T | 81 |
| 2FH21F_07_004 | 21 | 100017701 | R | 107 | 7 | 151532925 | R | A | 107 |
| 2FH21F_07_009 | 21 | 100017727 | F | 117 | 7 | 151532951 | F | A | 117 |
| 2FH21F_07_016 | 21 | 100018035 | R | 114 | 7 | 151533262 | R | T | 114 |
| 2FH21F_07_017 | 21 | 100018739 | F | 112 | 7 | 151533969 | F | C | 112 |
| 2FH21F_07_018 | 21 | 100019087 | R | 99 | 7 | 151534313 | R | C | 105 |
| 2FH21F_07_021 | 21 | 100019153 | F | 119 | 7 | 151534385 | F | A | 119 |
| 2FH21F_07_022 | 21 | 100019238 | R | 88 | 7 | 151534470 | R | T | 88 |
| 2FH21F_07_025 | 21 | 100019293 | F | 92 | 7 | 151532925 | F | C | 92 |
| 2FH21F_07_026 | 21 | 100019407 | R | 89 | 7 | 151534640 | R | C | 90 |
| 2FH21F_07_027 | 21 | 100019536 | F | 113 | 7 | 151534770 | F | A | 113 |
| 2FH21F_07_028 | 21 | 100019592 | R | 103 | 7 | 151534826 | R | A | 103 |
| 2FH21F_07_029 | 21 | 100019645 | F | 101 | 7 | 151534879 | F | C | 101 |
| 2FH21F_07_030 | 21 | 100019826 | F | 118 | 7 | 151535060 | F | C | 118 |
| 2FH21F_07_033 | 21 | 100019853 | F | 90 | 7 | 151535387 | F | C | 90 |

TABLE 4A-continued

| | | | | | | | | | | |
|---|---|---|---|---|---|---|---|---|---|---|
| 2FH21F_07_035 | 21 | 10020360 | F | C | 102 | 7 | 151535594 | F | A | 102 |
| 2FH21F_07_036 | 21 | 10020375 | R | C | 102 | 7 | 151535609 | R | G | 102 |
| 2FH21F_07_037 | 21 | 10020466 | R | C | 115 | 7 | 151535700 | R | T | 115 |
| 2FH21F_07_042 | 21 | 10021598 | F | A | 101 | 7 | 151536832 | F | G | 101 |
| 2FH21F_07_050 | 21 | 10054407 | F | C | 112 | 7 | 151569685 | F | G | 113 |
| 2FH21F_07_052 | 21 | 10054485 | F | T | 104 | 7 | 151569764 | F | C | 104 |
| 2FH21F_07_053 | 21 | 10054494 | R | A | 104 | 7 | 151569773 | R | G | 104 |
| 2FH21F_07_057 | 21 | 10054889 | F | T | 81 | 7 | 151570171 | F | C | 81 |
| 2FH21F_07_058 | 21 | 10054933 | F | A | 106 | 7 | 151570215 | F | C | 107 |
| 2FH21F_07_059 | 21 | 10054956 | R | C | 110 | 7 | 151570239 | R | T | 111 |
| 2FH21F_07_061 | 21 | 10055024 | R | G | 116 | 7 | 151570307 | R | A | 116 |
| 2FH21F_07_063 | 21 | 10055125 | F | A | 119 | 7 | 151570408 | F | G | 118 |
| 2FH21F_07_064 | 21 | 10055296 | F | T | 108 | 7 | 151570578 | F | C | 108 |
| 2FH21F_07_067 | 21 | 10055438 | R | A | 119 | 7 | 151570720 | R | C | 119 |
| 2FH21F_07_071 | 21 | 10055681 | R | C | 107 | 7 | 151570963 | R | G | 107 |
| 2FH21F_07_072 | 21 | 10055703 | F | C | 107 | 7 | 151570985 | F | C | 107 |
| 2FH21F_07_074 | 21 | 10055918 | R | T | 95 | 7 | 151571200 | R | C | 95 |
| 2FH21F_07_081 | 21 | 10056637 | R | G | 112 | 7 | 151571928 | R | C | 112 |
| 2FH21F_07_082 | 21 | 10056705 | R | C | 102 | 7 | 151571996 | R | A | 102 |
| 2FH21F_07_084 | 21 | 10057393 | F | A | 92 | 7 | 151572685 | F | G | 95 |
| 2FH21F_07_088 | 21 | 10057855 | R | A | 116 | 7 | 151573150 | R | G | 117 |
| 2FH21F_07_090 | 21 | 10058493 | R | A | 104 | 7 | 151573797 | R | C | 104 |
| 2FH21F_07_094 | 21 | 10059025 | R | A | 105 | 7 | 151574328 | R | G | 105 |
| 2FH21F_07_095 | 21 | 10059172 | F | A | 101 | 7 | 151574474 | F | C | 101 |
| 2FH21F_07_105 | 21 | 10059945 | F | G | 106 | 7 | 151574848 | F | T | 107 |
| 2FH21F_07_106 | 21 | 10059627 | F | T | 92 | 7 | 151574931 | F | G | 92 |
| 2FH21F_07_109 | 21 | 10059776 | R | C | 116 | 7 | 151575081 | R | A | 116 |
| 2FH21F_07_112 | 21 | 10059962 | R | G | 82 | 7 | 151575268 | R | A | 86 |
| 2FH21F_07_115 | 21 | 10061071 | F | A | 115 | 7 | 151576385 | F | C | 115 |
| 2FH21F_07_116 | 21 | 10061077 | R | A | 109 | 7 | 151576391 | R | T | 109 |
| 2FH21F_07_117 | 21 | 10061102 | F | T | 109 | 7 | 151576416 | F | C | 109 |
| 2FH21F_07_119 | 21 | 10061143 | R | C | 110 | 7 | 151576457 | R | T | 110 |
| 2FH21F_07_122 | 21 | 10061299 | F | G | 116 | 7 | 151576613 | F | A | 116 |
| 2FH21F_07_128 | 21 | 10061656 | R | C | 100 | 7 | 151576973 | R | G | 100 |
| 2FH21F_07_130 | 21 | 10061746 | R | C | 92 | 7 | 151577063 | R | A | 92 |
| 2FH21F_07_131 | 21 | 10061791 | F | G | 120 | 7 | 151577108 | F | A | 120 |
| 2FH21F_07_135 | 21 | 10062478 | R | G | 112 | 7 | 151577796 | R | C | 112 |
| 2FH21F_07_136 | 21 | 10062502 | R | T | 118 | 7 | 151577820 | R | C | 118 |
| 2FH21F_07_133 | 21 | 10066094 | R | T | 93 | 7 | 151587748 | R | A | 93 |
| 2FH21F_07_142 | 21 | 10066675 | R | A | 99 | 7 | 151588323 | R | A | 99 |
| 2FH21F_07_143 | 21 | 10066747 | F | A | 116 | 7 | 151588395 | F | T | 115 |
| 2FH21F_07_147 | 21 | 10067472 | R | C | 104 | 7 | 151589126 | R | A | 108 |
| 2FH21F_07_150 | 21 | 10067666 | F | G | 108 | 7 | 151589324 | F | G | 108 |
| 2FH21F_07_151 | 21 | 10067696 | R | T | 97 | 7 | 151589354 | R | C | 97 |
| 2FH21F_07_152 | 21 | 10067754 | F | T | 96 | 7 | 151589412 | F | C | 99 |
| 2FH21F_07_153 | 21 | 10067846 | F | A | 102 | 7 | 151589507 | F | G | 99 |
| 2FH21F_07_156 | 21 | 10068270 | R | G | 103 | 7 | 151589937 | R | A | 103 |
| 2FH21F_07_157 | 21 | 10068378 | R | C | 112 | 7 | 151590045 | R | A | 112 |
| 2FH21F_07_160 | 21 | 10068563 | F | C | 101 | 7 | 151590229 | F | A | 101 |
| 2FH21F_07_161 | 21 | 10068616 | R | T | 120 | 7 | 151590282 | R | C | 120 |
| 2FH21F_07_164 | 21 | 10068653 | F | C | 120 | 7 | 151590319 | F | A | 120 |
| 2FH21F_07_166 | 21 | 10068814 | F | C | 109 | 7 | 151590480 | F | A | 109 |
| 2FH21F_07_168 | 21 | 10069480 | F | G | 94 | 7 | 151591156 | F | A | 94 |

TABLE 4A-continued

| | | | | | | | | | |
|---|---|---|---|---|---|---|---|---|---|
| 2FH21F_07_176 | 21 | 100070235 | F | G | 116 | 7 | 151591914 | F | A | 115 |
| 2FH21F_07_178 | 21 | 100070329 | R | G | 113 | 7 | 151592007 | R | A | 113 |
| 2FH21F_07_179 | 21 | 100070373 | F | A | 116 | 7 | 151592051 | F | G | 114 |
| 2FH21F_07_180 | 21 | 100070397 | R | C | 92 | 7 | 151592073 | R | G | 90 |
| 2FH21F_07_181 | 21 | 100070432 | R | C | 82 | 7 | 151592108 | R | T | 82 |
| 2FH21F_07_183 | 21 | 100070468 | R | C | 107 | 7 | 151592144 | R | T | 107 |
| 2FH21F_07_186 | 21 | 100070670 | F | G | 119 | 7 | 151592346 | F | A | 119 |
| 2FH21F_07_187 | 21 | 100070767 | R | A | 119 | 7 | 151592443 | R | C | 119 |
| 2FH21F_07_188 | 21 | 100070815 | F | A | 120 | 7 | 151592491 | F | G | 120 |
| 2FH21F_07_194 | 21 | 100071259 | R | T | 99 | 7 | 151592988 | R | C | 99 |
| 2FH21F_07_195 | 21 | 100071393 | F | G | 96 | 7 | 151593122 | F | C | 96 |
| 2FH21F_07_198 | 21 | 100071650 | F | T | 115 | 7 | 151593379 | F | A | 115 |
| 2FH21F_07_200 | 21 | 100071825 | F | C | 108 | 7 | 151593554 | F | C | 108 |
| 2FH21F_07_202 | 21 | 100071854 | F | C | 108 | 7 | 151593583 | F | A | 108 |
| 2FH21F_07_203 | 21 | 100071857 | R | C | 114 | 7 | 151593586 | R | T | 114 |
| 2FH21F_07_207 | 21 | 100072259 | F | A | 102 | 7 | 151593988 | F | C | 102 |
| 2FH21F_07_210 | 21 | 100072886 | F | T | 93 | 7 | 151594614 | F | C | 93 |
| 2FH21F_07_211 | 21 | 100074617 | R | C | 93 | 7 | 151596351 | R | C | 91 |
| 2FH21F_07_212 | 21 | 100074885 | F | G | 119 | 7 | 151596617 | F | A | 119 |
| 2FH21F_07_214 | 21 | 100075462 | F | A | 96 | 7 | 151597193 | F | T | 96 |
| 2FH21F_07_215 | 21 | 100075500 | R | C | 116 | 7 | 151597211 | R | T | 116 |
| 2FH21F_07_216 | 21 | 100075520 | F | C | 116 | 7 | 151597231 | F | A | 116 |
| 2FH21F_07_219 | 21 | 100075639 | R | T | 101 | 7 | 151597352 | R | G | 99 |
| 2FH21F_07_220 | 21 | 100075694 | F | A | 81 | 7 | 151597407 | F | G | 81 |
| 2FH21F_07_223 | 21 | 100076079 | R | A | 113 | 7 | 151597787 | R | C | 113 |
| 2FH21F_07_226 | 21 | 100076263 | R | T | 110 | 7 | 151597971 | R | C | 110 |
| 2FH21F_07_229 | 21 | 100076329 | F | G | 117 | 7 | 151598037 | F | T | 117 |
| 2FH21F_07_230 | 21 | 100076363 | F | G | 104 | 7 | 151598071 | F | T | 104 |
| 2FH21F_07_233 | 21 | 100076479 | F | A | 118 | 7 | 151598187 | F | T | 118 |
| 2FH21F_07_234 | 21 | 100078516 | R | A | 114 | 7 | 151600224 | R | A | 114 |
| 2FH21F_07_235 | 21 | 100078568 | R | A | 119 | 7 | 151600271 | R | G | 114 |
| 2FH21F_07_238 | 21 | 100078595 | R | A | 84 | 7 | 151600298 | R | G | 84 |
| 2FH21F_07_239 | 21 | 100078870 | F | A | 100 | 7 | 151600575 | F | C | 99 |
| 2FH21F_07_240 | 21 | 100078889 | F | A | 111 | 7 | 151600593 | F | C | 110 |
| 2FH21F_07_242 | 21 | 100079022 | R | G | 89 | 7 | 151600722 | R | T | 85 |
| 2FH21F_07_243 | 21 | 100079119 | R | C | 106 | 7 | 151600819 | R | T | 107 |
| 2FH21F_07_245 | 21 | 100079159 | F | T | 82 | 7 | 151600859 | F | T | 82 |
| 2FH21F_07_247 | 21 | 100079191 | F | A | 117 | 7 | 151600891 | F | A | 116 |
| 2FH21F_07_253 | 21 | 100079219 | F | A | 105 | 7 | 151600918 | F | A | 116 |
| 2FH21F_07_254 | 21 | 100079325 | R | G | 99 | 7 | 151601024 | R | T | 105 |
| 2FH21F_07_256 | 21 | 100079512 | F | T | 131 | 7 | 151601209 | F | T | 95 |
| 2FH21F_07_262 | 21 | 100079748 | F | T | 120 | 7 | 151601433 | F | T | 119 |
| 2FH21F_07_264 | 21 | 100079996 | R | C | 110 | 7 | 151601681 | R | T | 120 |
| 2FH21F_07_268 | 21 | 100080693 | F | A | 99 | 7 | 151602391 | F | G | 118 |
| 2FH21F_07_269 | 21 | 100080826 | F | A | 101 | 7 | 151602525 | F | G | 99 |
| 2FH21F_07_270 | 21 | 100081077 | F | C | 103 | 7 | 151602776 | F | A | 101 |
| 2FH21F_07_271 | 21 | 100081089 | R | T | 99 | 7 | 151602788 | R | T | 103 |
| 2FH21F_07_277 | 21 | 100081127 | R | T | 117 | 7 | 151602826 | R | C | 99 |
| 2FH21F_07_279 | 21 | 100081152 | R | G | 99 | 7 | 151602851 | R | C | 117 |
| 2FH21F_07_282 | 21 | 100081324 | F | T | 95 | 7 | 151603023 | F | A | 99 |
| 2FH21F_07_283 | 21 | 100081461 | R | T | 116 | 7 | 151603160 | R | C | 95 |
| | 21 | 100081890 | F | T | 118 | 7 | 151603589 | F | C | 118 |
| | 21 | 100081972 | R | G | 103 | 7 | 151603668 | R | A | 98 |

TABLE 4A-continued

| | | | | | | | | | |
|---|---|---|---|---|---|---|---|---|---|
| 2FH21F_07_289 | 21 | 10082542 | F | C | 92 | 7 | 151604238 | F | T | 92 |
| 2FH21F_07_293 | 21 | 10083271 | F | G | 109 | 7 | 151604963 | F | C | 112 |
| 2FH21F_07_298 | 21 | 10083542 | R | G | 84 | 7 | 151605235 | R | A | 84 |
| 2FH21F_07_302 | 21 | 10085885 | F | G | 112 | 7 | 151607541 | F | A | 112 |
| 2FH21F_07_303 | 21 | 10085999 | F | T | 110 | 7 | 151607655 | F | C | 110 |
| 2FH21F_07_304 | 21 | 10086054 | R | T | 115 | 7 | 151607715 | R | A | 120 |
| 2FH21F_07_305 | 21 | 10087226 | F | G | 106 | 7 | 151608858 | F | C | 106 |
| 2FH21F_07_306 | 21 | 10087247 | R | C | 106 | 7 | 151608879 | R | A | 106 |
| 2FH21F_07_307 | 21 | 10087343 | F | A | 96 | 7 | 151608975 | F | T | 94 |
| 2FH21F_07_308 | 21 | 10087356 | R | T | 100 | 7 | 151608986 | R | T | 98 |
| 2FH21F_07_309 | 21 | 10087427 | F | T | 111 | 7 | 151609057 | F | A | 111 |
| 2FH21F_07_312 | 21 | 10089160 | F | C | 89 | 7 | 151610833 | F | C | 87 |
| 2FH21F_07_321 | 21 | 10089979 | F | T | 104 | 7 | 151611658 | F | A | 104 |
| 2FH21F_07_323 | 21 | 10090076 | R | A | 92 | 7 | 151611755 | R | G | 91 |
| 2FH21F_07_325 | 21 | 10090219 | R | A | 118 | 7 | 151611897 | R | A | 118 |
| 2FH21F_07_329 | 21 | 10101118 | F | G | 88 | 7 | 151706710 | F | C | 88 |
| 2FH21F_07_331 | 21 | 10101393 | F | T | 113 | 7 | 151706985 | F | G | 113 |
| 2FH21F_07_332 | 21 | 10101424 | F | T | 98 | 7 | 151707016 | F | T | 97 |
| 2FH21F_07_333 | 21 | 10101607 | F | A | 107 | 7 | 151707208 | F | C | 117 |
| 2FH21F_07_334 | 21 | 10103626 | R | T | 101 | 7 | 151708905 | R | G | 101 |
| 2FH21F_07_335 | 21 | 10103674 | F | A | 107 | 7 | 151708953 | F | C | 107 |
| 2FH21F_07_337 | 21 | 10103849 | R | A | 92 | 7 | 151709127 | R | C | 92 |
| 2FH21F_07_340 | 21 | 10104391 | R | T | 120 | 7 | 151709669 | R | G | 120 |
| 2FH21F_07_343 | 21 | 10104535 | R | C | 104 | 7 | 151709817 | R | A | 104 |
| 2FH21F_07_347 | 21 | 10104730 | F | C | 100 | 7 | 151710012 | F | T | 100 |
| 2FH21F_07_349 | 21 | 10104735 | R | A | 118 | 7 | 151710067 | R | T | 118 |
| 2FH21F_07_351 | 21 | 10104973 | R | T | 115 | 7 | 151710255 | R | C | 115 |
| 2FH21F_07_352 | 21 | 10104999 | R | G | 115 | 7 | 151710281 | R | A | 115 |
| 2FH21F_07_354 | 21 | 10105057 | F | C | 117 | 7 | 151710339 | F | T | 117 |
| 2FH21F_07_355 | 21 | 10105089 | R | C | 82 | 7 | 151710371 | R | G | 82 |
| 2FH21F_07_356 | 21 | 10105122 | F | A | 105 | 7 | 151710404 | F | C | 105 |
| 2FH21F_07_357 | 21 | 10105140 | R | A | 105 | 7 | 151710422 | R | C | 105 |
| 2FH21F_07_358 | 21 | 10105198 | R | A | 95 | 7 | 151710480 | R | C | 95 |
| 2FH21F_07_359 | 21 | 10105280 | F | T | 119 | 7 | 151710562 | F | T | 119 |
| 2FH21F_07_360 | 21 | 10105284 | R | C | 92 | 7 | 151710566 | R | G | 92 |
| 2FH21F_07_365 | 21 | 10106079 | R | C | 113 | 7 | 151711353 | R | A | 108 |
| 2FH21F_07_366 | 21 | 10106087 | F | G | 108 | 7 | 151711361 | F | T | 108 |
| 2FH21F_07_367 | 21 | 10106124 | R | C | 116 | 7 | 151711398 | R | T | 116 |
| 2FH21F_07_368 | 21 | 10106166 | R | C | 107 | 7 | 151711440 | R | A | 107 |
| 2FH21F_07_369 | 21 | 10106228 | R | C | 113 | 7 | 151711502 | R | A | 113 |
| 2FH21F_07_370 | 21 | 10106248 | F | T | 113 | 7 | 151711522 | F | T | 113 |
| 2FH21F_07_371 | 21 | 10106297 | F | C | 96 | 7 | 151711571 | F | C | 96 |
| 2FH21F_07_373 | 21 | 10106738 | R | C | 85 | 7 | 151712012 | R | T | 88 |
| 2FH21F_07_374 | 21 | 10106828 | R | C | 119 | 7 | 151712103 | R | A | 117 |
| 2FH21F_07_375 | 21 | 10106864 | F | T | 94 | 7 | 151712139 | F | T | 90 |
| 2FH21F_07_376 | 21 | 10106874 | R | T | 95 | 7 | 151712663 | R | A | 95 |
| 2FH21F_07_377 | 21 | 10107874 | F | C | 80 | 7 | 151715027 | F | C | 80 |
| 2FH21F_07_380 | 21 | 10109898 | R | G | 114 | 7 | 151715373 | R | T | 116 |
| 2FH21F_07_381 | 21 | 10110237 | R | G | 92 | 7 | 151715405 | R | C | 107 |
| 2FH21F_07_385 | 21 | 10110269 | F | T | 99 | 7 | 151715879 | F | A | 92 |
| 2FH21F_07_391 | 21 | 10111466 | R | C | 98 | 7 | 151716644 | R | T | 99 |
| 2FH21F_07_393 | 21 | 10112627 | F | T | 100 | 7 | 151717812 | F | C | 98 |
| 2FH21F_07_394 | 21 | 10113252 | F | G | 96 | 7 | 151718440 | F | A | 100 |

TABLE 4A-continued

| | | | | | | | | | |
|---|---|---|---|---|---|---|---|---|---|
| 2FH21F_07_395 | 21 | 10114677 | F | T | 110 | 7 | 151719888 | F | C | 110 |
| 2FH21F_07_397 | 21 | 10115023 | F | G | 92 | 7 | 151720234 | F | C | 92 |
| 2FH21F_07_398 | 21 | 10115084 | R | T | 85 | 7 | 151720295 | R | C | 85 |
| 2FH21F_07_399 | 21 | 10115123 | F | C | 81 | 7 | 151720334 | F | T | 81 |
| 2FH21F_07_402 | 21 | 10115294 | R | T | 83 | 7 | 151720505 | R | G | 83 |
| 2FH21F_07_403 | 21 | 10115433 | F | A | 103 | 7 | 151720644 | F | G | 103 |
| 2FH21F_07_405 | 21 | 10116089 | F | C | 101 | 7 | 151721214 | F | G | 101 |
| 2FH21F_07_406 | 21 | 10116140 | R | A | 119 | 7 | 151721265 | R | C | 119 |
| 2FH21F_07_407 | 21 | 10116273 | R | T | 120 | 7 | 151721398 | R | C | 120 |
| 2FH21F_07_416 | 21 | 10119088 | R | T | 95 | 7 | 151729790 | R | C | 95 |
| 2FH21F_07_419 | 21 | 26029711 | R | C | 82 | 7 | 62991014 | R | G | 82 |
| 2FH21F_07_420 | 21 | 26052351 | R | G | 120 | 7 | 62991802 | R | A | 120 |
| 2FH21F_07_421 | 21 | 26058471 | R | A | 103 | 7 | 62991971 | R | G | 103 |
| 2FH21F_07_422 | 21 | 26058506 | R | G | 87 | 7 | 62992003 | R | C | 84 |
| 2FH21F_07_423 | 21 | 26063275 | F | T | 100 | 7 | 62992312 | F | C | 100 |
| 2FH21F_07_426 | 21 | 26063642 | R | A | 119 | 7 | 62992679 | R | G | 122 |
| 2FH21F_07_427 | 21 | 26063674 | F | A | 107 | 7 | 62992711 | F | G | 110 |
| 2FH21F_07_429 | 21 | 26063792 | F | T | 90 | 7 | 62992832 | F | A | 90 |
| 2FH21F_07_430 | 21 | 26063870 | R | C | 106 | 7 | 62992910 | R | A | 106 |
| 2FH21F_07_431 | 21 | 26064006 | R | A | 86 | 7 | 62993046 | R | G | 86 |
| 2FH21F_07_434 | 21 | 26064248 | R | T | 113 | 7 | 62993288 | R | G | 113 |
| 2FH21F_07_437 | 21 | 26064421 | F | A | 113 | 7 | 62993461 | F | G | 113 |
| 2FH21F_07_438 | 21 | 26064428 | F | T | 118 | 7 | 62993468 | F | C | 122 |
| 2FH21F_07_439 | 21 | 26064471 | R | T | 115 | 7 | 62993511 | R | A | 120 |
| 2FH21F_07_443 | 21 | 26064690 | F | G | 104 | 7 | 62993736 | F | T | 104 |
| 2FH21F_07_444 | 21 | 26064883 | F | C | 107 | 7 | 62993934 | F | T | 106 |
| 2FH21F_07_445 | 21 | 26064992 | F | G | 120 | 7 | 62994042 | F | A | 120 |
| 2FH21F_07_447 | 21 | 26065229 | F | A | 98 | 7 | 62994284 | F | C | 98 |
| 2FH21F_07_452 | 21 | 26065616 | R | A | 80 | 7 | 62994670 | R | A | 85 |
| 2FH21F_07_454 | 21 | 26065675 | R | G | 86 | 7 | 62994734 | R | A | 86 |
| 2FH21F_07_457 | 21 | 26066063 | R | G | 79 | 7 | 62995130 | R | C | 84 |
| 2FH21F_07_459 | 21 | 26066149 | R | T | 109 | 7 | 62995221 | R | C | 109 |
| 2FH21F_07_460 | 21 | 26066207 | F | T | 87 | 7 | 62995279 | F | T | 87 |
| 2FH21F_07_462 | 21 | 28675597 | F | C | 119 | 7 | 57161078 | F | T | 119 |
| 2FH21F_07_463 | 21 | 28675666 | R | C | 120 | 7 | 57161147 | R | T | 120 |
| 2FH21F_07_464 | 21 | 28900500 | F | G | 119 | 8 | 42279914 | F | T | 119 |
| 2FH21F_07_465 | 21 | 28900549 | R | C | 104 | 8 | 42279865 | R | C | 104 |
| 2FH21F_07_466 | 21 | 28900702 | F | G | 99 | 8 | 42280104 | F | A | 99 |
| 2FH21F_07_474 | 21 | 34400356 | R | C | 114 | 8 | 130139932 | R | T | 114 |
| 2FH21F_07_475 | 21 | 35894307 | F | C | 118 | 8 | 148135521 | F | T | 118 |
| 2FH21F_07_476 | 21 | 40333032 | R | C | 82 | 8 | 121388053 | R | A | 82 |
| 2FH21F_07_479 | 21 | 45508375 | R | T | 93 | 8 | 125645926 | R | A | 93 |
| 2FH21F_07_480 | 21 | 45508426 | F | C | 91 | 8 | 125645977 | F | C | 91 |
| 2FH21F_07_482 | 21 | 45508473 | R | A | 107 | 8 | 125646024 | R | T | 113 |
| 2FH21F_07_483 | 21 | 45508504 | F | A | 118 | 8 | 125646055 | F | T | 128 |
| 2FH21F_08_001 | 21 | 14371001 | R | G | 107 | 8 | 47060648 | R | A | 107 |
| 2FH21F_08_003 | 21 | 17783776 | F | A | 106 | 8 | 52794904 | F | G | 106 |
| 2FH21F_08_004 | 21 | 17783855 | R | A | 89 | 8 | 52794983 | R | T | 89 |
| 2FH21F_08_008 | 21 | 23758768 | F | C | 99 | 8 | 131135676 | F | A | 99 |
| 2FH21F_08_009 | 21 | 23758804 | R | T | 103 | 8 | 131135640 | R | T | 103 |
| 2FH21F_08_010 | 21 | 23758828 | F | A | 116 | 8 | 131135616 | F | C | 116 |
| 2FH21F_08_013 | 21 | 23759109 | F | A | 100 | 8 | 131135335 | R | G | 100 |
| 2FH21F_08_014 | 21 | 39452121 | R | A | 100 | 8 | 121215010 | R | G | 100 |

TABLE 4A-continued

| | | | | | | | | | |
|---|---|---|---|---|---|---|---|---|---|
| 2FH21F_08_016 | 21 | 40846776 | F | T | 96 | 8 | 25626542 | F | A | 95 |
| 2FH21F_08_017 | 21 | 46479557 | F | T | 119 | 8 | 130332631 | R | G | 119 |
| 2FH21F_09_004 | 21 | 20468633 | F | T | 94 | 9 | 114431868 | R | G | 99 |
| 2FH21F_09_005 | 21 | 20468858 | R | T | 99 | 9 | 114431838 | F | A | 104 |
| 2FH21F_09_007 | 21 | 20468716 | F | C | 103 | 9 | 114431780 | F | G | 103 |
| 2FH21F_09_010 | 21 | 20468878 | R | T | 80 | 9 | 114431624 | R | A | 80 |
| 2FH21F_09_013 | 21 | 20469264 | R | T | 102 | 9 | 114431015 | F | C | 103 |
| 2FH21F_09_016 | 21 | 20469522 | F | C | 108 | 9 | 114431266 | F | T | 108 |
| 2FH21F_09_018 | 21 | 32523837 | R | A | 111 | 9 | 15976292 | R | C | 118 |
| 2FH21F_10_003 | 21 | 26638582 | F | T | 88 | 10 | 69347648 | F | G | 88 |
| 2FH21F_10_006 | 21 | 26638665 | R | G | 118 | 10 | 69347731 | R | A | 118 |
| 2FH21F_10_007 | 21 | 26638706 | F | T | 111 | 10 | 69347772 | F | C | 111 |
| 2FH21F_10_011 | 21 | 26638769 | R | A | 92 | 10 | 69347835 | R | T | 92 |
| 2FH21F_10_016 | 21 | 26639000 | F | C | 100 | 10 | 69348063 | F | T | 100 |
| 2FH21F_10_018 | 21 | 36780234 | R | A | 106 | 10 | 95708632 | R | G | 106 |
| 2FH21F_10_019 | 21 | 36780339 | F | G | 116 | 10 | 95708737 | F | C | 116 |
| 2FH21F_10_020 | 21 | 36780343 | R | A | 116 | 10 | 95708741 | R | C | 116 |
| 2FH21F_11_001 | 21 | 46486292 | F | A | 100 | 10 | 28159033 | F | T | 100 |
| 2FH21F_11_002 | 21 | 233395848 | R | G | 113 | 10 | 124150014 | R | C | 113 |
| 2FH21F_11_003 | 21 | 233395850 | F | A | 113 | 10 | 124150012 | F | A | 113 |
| 2FH21F_11_005 | 21 | 233395873 | R | C | 95 | 11 | 124149989 | R | C | 95 |
| 2FH21F_11_006 | 21 | 233395905 | F | A | 116 | 11 | 124149957 | F | G | 116 |
| 2FH21F_11_007 | 21 | 233396494 | R | T | 120 | 11 | 124143062 | R | G | 119 |
| 2FH21F_11_009 | 21 | 233396572 | F | G | 108 | 11 | 124142985 | F | C | 108 |
| 2FH21F_11_010 | 21 | 233396581 | R | A | 108 | 11 | 124142976 | R | C | 108 |
| 2FH21F_11_011 | 21 | 233396894 | F | T | 119 | 11 | 124142661 | F | G | 119 |
| 2FH21F_11_013 | 21 | 233397275 | R | G | 116 | 11 | 124142280 | R | A | 116 |
| 2FH21F_11_014 | 21 | 233397327 | F | T | 105 | 11 | 124142228 | F | C | 105 |
| 2FH21F_11_015 | 21 | 233397405 | R | T | 110 | 11 | 124142150 | R | A | 110 |
| 2FH21F_11_019 | 21 | 233397432 | F | T | 120 | 11 | 124142123 | F | C | 120 |
| 2FH21F_11_020 | 21 | 25986415 | R | A | 115 | 11 | 109811803 | R | C | 117 |
| 2FH21F_11_022 | 21 | 25986457 | F | T | 108 | 11 | 109811847 | F | C | 110 |
| 2FH21F_11_023 | 21 | 29170479 | R | A | 98 | 11 | 92982462 | R | T | 99 |
| 2FH21F_11_024 | 21 | 29170506 | F | G | 100 | 11 | 92982490 | F | T | 101 |
| 2FH21F_11_026 | 21 | 29170534 | R | A | 121 | 11 | 92982518 | R | G | 121 |
| 2FH21F_11_027 | 21 | 29170588 | F | G | 121 | 11 | 92982572 | F | A | 119 |
| 2FH21F_11_028 | 21 | 29170613 | R | G | 96 | 11 | 92982595 | R | A | 94 |
| 2FH21F_11_029 | 21 | 37392976 | F | C | 107 | 11 | 66718478 | F | A | 107 |
| 2FH21F_11_030 | 21 | 37393011 | R | C | 81 | 11 | 66718443 | R | A | 81 |
| 2FH21F_11_033 | 21 | 39479721 | F | C | 83 | 11 | 77021841 | F | G | 83 |
| 2FH21F_12_003 | 21 | 40282355 | R | A | 115 | 12 | 8622624 | R | G | 115 |
| 2FH21F_12_011 | 21 | 143364374 | F | T | 88 | 12 | 36842346 | F | G | 88 |
| 2FH21F_12_012 | 21 | 143365323 | R | T | 81 | 12 | 36841410 | R | G | 81 |
| 2FH21F_12_013 | 21 | 143368770 | F | C | 101 | 12 | 36831590 | F | G | 101 |
| 2FH21F_12_015 | 21 | 143368851 | R | C | 120 | 12 | 36831509 | R | A | 120 |
| 2FH21F_12_016 | 21 | 143368945 | F | A | 83 | 12 | 36831415 | F | T | 83 |
| 2FH21F_12_032 | 21 | 143369156 | R | G | 112 | 12 | 36831204 | R | T | 112 |
| 2FH21F_12_036 | 21 | 143969950 | F | C | 109 | 12 | 36794298 | F | G | 109 |
| 2FH21F_12_039 | 21 | 144000021 | R | T | 117 | 12 | 36791807 | R | G | 115 |
| 2FH21F_12_048 | 21 | 18364441 | F | T | 93 | 12 | 19154702 | F | G | 93 |
| 2FH21F_12_049 | 21 | 31116128 | R | C | 81 | 12 | 107311641 | R | G | 81 |
| 2FH21F_12_049 | 21 | 35466901 | F | T | 109 | 12 | 98716977 | F | A | 109 |
| 2FH21F_12_050 | 21 | 35466974 | F | C | 109 | 12 | 98716904 | R | A | 109 |

TABLE 4A-continued

| | | | | | | | | | |
|---|---|---|---|---|---|---|---|---|---|
| 2FH21F_12_051 | 21 | 35467003 | F | A | 109 | 12 | 98716875 | C | 109 |
| 2FH21F_12_052 | 21 | 35467007 | R | A | 109 | 12 | 98716871 | C | 109 |
| 2FH21F_12_053 | 21 | 35467047 | F | A | 107 | 12 | 98716831 | G | 107 |
| 2FH21F_12_054 | 21 | 35467071 | R | A | 101 | 12 | 98716807 | G | 101 |
| 2FH21F_12_057 | 21 | 35467870 | F | A | 81 | 12 | 98716023 | A | 89 |
| 2FH21F_12_058 | 21 | 35467877 | R | G | 102 | 12 | 98716008 | T | 110 |
| 2FH21F_12_060 | 21 | 36344402 | R | C | 103 | 12 | 8757741 | T | 103 |
| 2FH21F_12_064 | 21 | 36344480 | R | A | 98 | 12 | 8757819 | G | 98 |
| 2FH21F_12_066 | 21 | 36344707 | R | T | 116 | 12 | 8793866 | C | 116 |
| 2FH21F_12_068 | 21 | 36344961 | F | T | 112 | 12 | 8797830 | C | 112 |
| 2FH21F_12_071 | 21 | 36345046 | R | A | 100 | 12 | 8797915 | C | 100 |
| 2FH21F_12_072 | 21 | 36345177 | R | G | 102 | 12 | 8817273 | A | 102 |
| 2FH21F_12_073 | 21 | 36345212 | F | T | 108 | 12 | 8817308 | C | 108 |
| 2FH21F_12_074 | 21 | 36345252 | R | C | 87 | 12 | 8817348 | G | 87 |
| 2FH21F_12_075 | 21 | 36345286 | R | G | 120 | 12 | 8817382 | T | 120 |
| 2FH21F_12_076 | 21 | 36345299 | R | T | 105 | 12 | 8817395 | C | 105 |
| 2FH21F_12_077 | 21 | 36345331 | F | A | 98 | 12 | 8817427 | G | 98 |
| 2FH21F_12_078 | 21 | 36345350 | R | T | 98 | 12 | 8817446 | C | 98 |
| 2FH21F_12_079 | 21 | 36345382 | F | T | 108 | 12 | 8817478 | C | 108 |
| 2FH21F_12_080 | 21 | 36345422 | R | A | 107 | 12 | 8817518 | C | 107 |
| 2FH21F_12_081 | 21 | 36345599 | F | T | 111 | 12 | 8817695 | G | 111 |
| 2FH21F_12_032 | 21 | 36345703 | R | T | 115 | 12 | 8817795 | C | 123 |
| 2FH21F_12_083 | 21 | 36345712 | R | C | 119 | 12 | 8817804 | G | 119 |
| 2FH21F_12_084 | 21 | 36345749 | F | C | 115 | 12 | 8817841 | T | 119 |
| 2FH21F_12_086 | 21 | 36345790 | R | G | 115 | 12 | 8817888 | T | 108 |
| 2FH21F_12_088 | 21 | 36345832 | F | C | 106 | 12 | 8817930 | A | 113 |
| 2FH21F_12_094 | 21 | 36589553 | R | A | 111 | 12 | 119386208 | G | 84 |
| 2FH21F_12_095 | 21 | 36589583 | F | A | 84 | 12 | 119386238 | G | 97 |
| 2FH21F_12_098 | 21 | 36589734 | R | C | 97 | 12 | 119391656 | A | 114 |
| 2FH21F_12_103 | 21 | 40338511 | F | C | 114 | 12 | 43603073 | T | 81 |
| 2FH21F_12_104 | 21 | 40770445 | R | T | 81 | 12 | 56310838 | C | 99 |
| 2FH21F_12_105 | 21 | 40770469 | F | A | 99 | 12 | 56310814 | C | 99 |
| 2FH21F_12_106 | 21 | 40770473 | R | A | 99 | 12 | 56310810 | A | 103 |
| 2FH21F_12_107 | 21 | 40770509 | F | T | 103 | 12 | 56310774 | G | 120 |
| 2FH21F_12_112 | 21 | 43408873 | R | G | 120 | 12 | 6472542 | A | 104 |
| 2FH21F_12_113 | 21 | 43408884 | F | C | 103 | 12 | 6472553 | C | 104 |
| 2FH21F_12_114 | 21 | 43408906 | R | G | 103 | 12 | 6472575 | T | 104 |
| 2FH21F_13_005 | 21 | 9991870 | F | A | 85 | 13 | 18965568 | T | 89 |
| 2FH21F_13_019 | 21 | 14093183 | F | G | 105 | 13 | 18171241 | G | 105 |
| 2FH21F_13_020 | 21 | 14093198 | R | T | 104 | 13 | 18171256 | A | 104 |
| 2FH21F_13_022 | 21 | 14093293 | F | A | 116 | 13 | 18171351 | C | 116 |
| 2FH21F_13_023 | 21 | 14093337 | R | C | 112 | 13 | 18171395 | T | 112 |
| 2FH21F_13_026 | 21 | 14096743 | R | T | 96 | 13 | 18174798 | C | 96 |
| 2FH21F_13_028 | 21 | 14099425 | F | T | 119 | 13 | 18177481 | C | 119 |
| 2FH21F_13_031* | 21 | 14102405 | F | C | 109 | 13 | 18180495 | G | 109 |
| 2FH21F_13_032* | 21 | 14102433 | R | A | 116 | 13 | 18180523 | T | 116 |
| 2FH21F_13_033 | 21 | 14102490 | F | G | 104 | 13 | 18180580 | A | 104 |
| 2FH21F_13_035 | 21 | 14103122 | F | C | 116 | 13 | 18181212 | G | 116 |
| 2FH21F_13_036 | 21 | 14103149 | R | A | 80 | 13 | 18181239 | C | 80 |
| 2FH21F_13_039 | 21 | 14106660 | F | T | 116 | 13 | 18184718 | G | 116 |
| 2FH21F_13_040 | 21 | 14109261 | F | T | 120 | 13 | 18187316 | C | 120 |
| 2FH21F_13_041 | 21 | 14109738 | R | C | 89 | 13 | 18187793 | A | 89 |
| 2FH21F_13_042 | 21 | 14109824 | R | G | 106 | 13 | 18187879 | A | 106 |
| | | | | | 99 | | | | 99 |

TABLE 4A-continued

| | | | | | | | | | | |
|---|---|---|---|---|---|---|---|---|---|---|
| 2FH21F_13_043 | 21 | 141109914 | R | A | 101 | 13 | 18187969 | R | G | 101 |
| 2FH21F_13_046 | 21 | 141111144 | R | A | 103 | 13 | 18189204 | R | T | 104 |
| 2FH21F_13_047 | 21 | 141111203 | R | G | 88 | 13 | 18189263 | R | A | 88 |
| 2FH21F_13_048 | 21 | 141111249 | F | G | 95 | 13 | 18189309 | R | A | 95 |
| 2FH21F_13_049 | 21 | 141111290 | F | T | 92 | 13 | 18189350 | F | C | 92 |
| 2FH21F_13_051 | 21 | 141111371 | F | A | 99 | 13 | 18189431 | F | G | 99 |
| 2FH21F_13_052 | 21 | 141111381 | R | A | 90 | 13 | 18189441 | F | T | 90 |
| 2FH21F_13_054 | 21 | 141116424 | F | G | 85 | 13 | 18194428 | F | T | 85 |
| 2FH21F_13_057 | 21 | 141118994 | F | C | 120 | 13 | 18196941 | R | T | 120 |
| 2FH21F_13_059 | 21 | 141119045 | F | C | 120 | 13 | 18196992 | F | C | 120 |
| 2FH21F_13_060 | 21 | 141119121 | R | T | 114 | 13 | 18197068 | F | C | 114 |
| 2FH21F_13_062 | 21 | 141120815 | F | T | 100 | 13 | 18198762 | F | C | 100 |
| 2FH21F_13_065 | 21 | 141120978 | R | C | 92 | 13 | 18198925 | R | G | 92 |
| 2FH21F_13_066 | 21 | 141121175 | R | C | 87 | 13 | 18199129 | F | T | 87 |
| 2FH21F_13_068 | 21 | 141121570 | F | G | 100 | 13 | 18199524 | F | A | 100 |
| 2FH21F_13_071 | 21 | 141141636 | R | T | 114 | 13 | 18214549 | R | C | 114 |
| 2FH21F_13_077* | 21 | 14643157 | F | G | 120 | 13 | 71046877 | F | A | 120 |
| 2FH21F_13_079* | 21 | 17407356 | F | C | 113 | 13 | 50189919 | R | A | 113 |
| 2FH21F_13_082* | 21 | 191622925 | F | C | 87 | 13 | 49661632 | R | T | 87 |
| 2FH21F_13_083* | 21 | 191622941 | R | G | 121 | 13 | 49661616 | R | C | 121 |
| 2FH21F_13_084* | 21 | 191622971 | F | T | 121 | 13 | 49661586 | F | T | 121 |
| 2FH21F_13_088* | 21 | 191631145 | R | C | 116 | 13 | 49661415 | R | G | 116 |
| 2FH21F_13_099 | 21 | 359999919 | R | A | 90 | 13 | 88808282 | R | T | 90 |
| 2FH21F_13_101* | 21 | 360000063 | R | A | 107 | 13 | 88808136 | R | G | 107 |
| 2FH21F_13_105 | 21 | 36000702 | F | C | 94 | 13 | 88807508 | F | A | 91 |
| 2FH21F_13_107 | 21 | 36001079 | R | C | 100 | 13 | 88807132 | F | T | 100 |
| 2FH21F_13_108 | 21 | 36001146 | F | C | 121 | 13 | 88807065 | R | A | 121 |
| 2FH21F_13_110 | 21 | 36001377 | F | G | 116 | 13 | 88806834 | R | C | 116 |
| 2FH21F_13_111 | 21 | 36001406 | F | T | 119 | 13 | 88806805 | F | T | 119 |
| 2FH21F_13_112 | 21 | 36001435 | F | T | 98 | 13 | 88806776 | R | T | 98 |
| 2FH21F_14_006 | 21 | 138879750 | R | A | 104 | 14 | 19381806 | R | G | 104 |
| 2FH21F_14_008 | 21 | 138879926 | F | C | 99 | 14 | 19381630 | R | C | 99 |
| 2FH21F_14_010 | 21 | 138880089 | F | T | 91 | 14 | 19381469 | R | A | 91 |
| 2FH21F_14_011 | 21 | 138880128 | R | A | 102 | 14 | 19381426 | R | T | 102 |
| 2FH21F_14_012 | 21 | 138880152 | F | A | 92 | 14 | 19381402 | R | C | 92 |
| 2FH21F_14_013 | 21 | 138880155 | R | C | 108 | 14 | 19381399 | R | C | 108 |
| 2FH21F_14_015 | 21 | 149921613 | F | T | 113 | 14 | 41185950 | R | A | 113 |
| 2FH21F_14_016 | 21 | 149921832 | F | T | 99 | 14 | 41185732 | F | T | 99 |
| 2FH21F_14_017 | 21 | 149921834 | F | T | 99 | 14 | 41185730 | F | T | 99 |
| 2FH21F_14_018 | 21 | 149921856 | F | C | 102 | 14 | 41185708 | R | G | 102 |
| 2FH21F_14_026 | 21 | 149922069 | F | C | 119 | 14 | 41185495 | R | A | 119 |
| 2FH21F_14_027 | 21 | 149922093 | F | T | 119 | 14 | 41185471 | R | T | 119 |
| 2FH21F_14_028 | 21 | 149922116 | R | C | 114 | 14 | 41185448 | F | C | 114 |
| 2FH21F_14_033 | 21 | 179466653 | F | T | 99 | 14 | 41092721 | F | A | 99 |
| 2FH21F_14_035 | 21 | 179947627 | R | T | 111 | 14 | 103093055 | R | A | 109 |
| 2FH21F_14_037 | 21 | 259973901 | F | C | 111 | 14 | 49818843 | R | G | 111 |
| 2FH21F_14_039 | 21 | 288867125 | F | T | 99 | 14 | 51943094 | R | G | 99 |
| 2FH21F_14_040 | 21 | 288867172 | F | T | 119 | 14 | 51943047 | R | A | 119 |
| 2FH21F_15_002 | 21 | 9885955 | R | T | 106 | 15 | 18428903 | F | C | 106 |
| 2FH21F_15_004 | 21 | 9886039 | F | T | 117 | 15 | 18428819 | F | T | 117 |
| 2FH21F_15_005 | 21 | 9886081 | R | A | 113 | 15 | 18428777 | F | G | 113 |
| 2FH21F_15_009 | 21 | 9886376 | R | A | 108 | 15 | 18428482 | F | C | 108 |
| 2FH21F_15_010 | 21 | 9886443 | F | A | 99 | 15 | 18428415 | R | A | 99 |

TABLE 4A-continued

| Name | | | | | | | | | | |
|---|---|---|---|---|---|---|---|---|---|---|
| 2FH21F_15_011 | 21 | 9886468 | R | G | 105 | 15 | 18428390 | F | T | 105 |
| 2FH21F_15_015 | 21 | 9886738 | R | G | 118 | 15 | 18428120 | F | T | 118 |
| 2FH21F_15_016 | 21 | 9886765 | F | T | 118 | 15 | 18428093 | R | T | 118 |
| 2FH21F_15_017 | 21 | 9886774 | F | T | 118 | 15 | 18428084 | F | G | 118 |
| 2FH21F_15_018 | 21 | 9886872 | F | T | 118 | 15 | 18427986 | F | G | 119 |
| 2FH21F_15_019 | 21 | 9886898 | F | C | 118 | 15 | 18427960 | R | G | 119 |
| 2FH21F_15_021 | 21 | 9886939 | F | T | 113 | 15 | 18427918 | R | G | 114 |
| 2FH21F_15_024 | 21 | 9887096 | F | C | 108 | 15 | 18427761 | R | A | 108 |
| 2FH21F_15_025 | 21 | 9887136 | R | A | 111 | 15 | 18427721 | F | C | 111 |
| 2FH21F_15_026 | 21 | 9887170 | F | A | 99 | 15 | 18427687 | R | G | 99 |
| 2FH21F_15_027 | 21 | 9887176 | R | G | 99 | 15 | 18427681 | F | T | 99 |
| 2FH21F_15_030 | 21 | 9887369 | R | C | 120 | 15 | 18427488 | F | T | 120 |
| 2FH21F_15_031 | 21 | 9887415 | F | C | 86 | 15 | 18427442 | R | A | 87 |
| 2FH21F_15_032 | 21 | 9887447 | F | G | 98 | 15 | 18427409 | F | T | 98 |
| 2FH21F_15_033 | 21 | 9887470 | R | G | 102 | 15 | 18427386 | R | T | 102 |
| 2FH21F_15_034 | 21 | 9887497 | R | C | 80 | 15 | 18427359 | F | C | 80 |
| 2FH21F_15_038 | 21 | 9887692 | F | T | 115 | 15 | 18427165 | F | T | 114 |
| 2FH21F_15_040 | 21 | 9887823 | F | C | 108 | 15 | 18427034 | R | G | 108 |
| 2FH21F_15_041 | 21 | 9887904 | R | A | 92 | 15 | 18426953 | F | G | 92 |
| 2FH21F_15_042 | 21 | 9888098 | F | T | 103 | 15 | 18426760 | R | A | 102 |
| 2FH21F_15_043 | 21 | 9888188 | R | G | 88 | 15 | 18426671 | F | C | 88 |
| 2FH21F_15_044 | 21 | 9888229 | F | T | 108 | 15 | 18426630 | R | T | 108 |
| 2FH21F_15_045 | 21 | 9888343 | F | C | 103 | 15 | 18426516 | R | A | 103 |
| 2FH21F_15_046 | 21 | 9888409 | R | C | 110 | 15 | 18426450 | F | T | 110 |
| 2FH21F_15_047 | 21 | 9888447 | F | C | 117 | 15 | 18426412 | R | C | 117 |
| 2FH21F_15_048 | 21 | 9888478 | F | G | 83 | 15 | 18426381 | R | T | 83 |
| 2FH21F_15_050 | 21 | 9888657 | F | C | 99 | 15 | 18426202 | R | G | 99 |
| 2FH21F_15_054 | 21 | 9889047 | R | T | 100 | 15 | 18425811 | F | C | 100 |
| 2FH21F_15_057 | 21 | 9889172 | R | A | 91 | 15 | 18425686 | R | T | 91 |
| 2FH21F_15_061 | 21 | 9890285 | F | T | 119 | 15 | 18424581 | F | G | 120 |
| 2FH21F_15_068 | 21 | 9891452 | F | T | 95 | 15 | 18423412 | R | G | 95 |
| 2FH21F_15_069 | 21 | 9892865 | R | G | 108 | 15 | 18422004 | R | G | 108 |
| 2FH21F_15_070 | 21 | 9892920 | F | T | 91 | 15 | 18421949 | R | G | 91 |
| 2FH21F_15_074 | 21 | 9893038 | F | T | 93 | 15 | 18421831 | F | T | 93 |
| 2FH21F_15_075 | 21 | 9893077 | R | A | 105 | 15 | 18421792 | R | G | 113 |
| 2FH21F_15_076 | 21 | 9893140 | R | G | 90 | 15 | 18421721 | F | T | 90 |
| 2FH21F_15_077 | 21 | 9893181 | F | G | 111 | 15 | 18421680 | F | G | 111 |
| 2FH21F_15_079 | 21 | 9893313 | R | A | 102 | 15 | 18421548 | R | A | 102 |
| 2FH21F_15_082 | 21 | 9893385 | F | G | 99 | 15 | 18421476 | F | C | 99 |
| 2FH21F_15_083 | 21 | 9893447 | R | G | 88 | 15 | 18421414 | R | T | 88 |
| 2FH21F_15_084 | 21 | 9893475 | F | A | 118 | 15 | 18421386 | F | A | 118 |
| 2FH21F_15_085 | 21 | 9893847 | F | T | 110 | 15 | 18421032 | R | C | 110 |
| 2FH21F_15_086 | 21 | 9893944 | R | G | 109 | 15 | 18420935 | F | C | 109 |
| 2FH21F_15_091 | 21 | 9894548 | R | G | 89 | 15 | 18420331 | R | C | 89 |
| 2FH21F_15_092 | 21 | 9894701 | F | T | 103 | 15 | 18420178 | F | T | 103 |
| 2FH21F_15_093 | 21 | 9894729 | F | C | 102 | 15 | 18420150 | F | G | 102 |
| 2FH21F_15_097 | 21 | 9903575 | F | T | 119 | 15 | 18413155 | R | A | 119 |
| 2FH21F_15_101 | 21 | 9903915 | R | T | 110 | 15 | 18412815 | R | C | 110 |
| 2FH21F_15_103 | 21 | 9905185 | F | A | 118 | 15 | 18411551 | F | C | 118 |
| 2FH21F_15_106 | 21 | 9906091 | F | T | 91 | 15 | 18410645 | R | G | 91 |
| 2FH21F_15_107 | 21 | 9906394 | F | C | 88 | 15 | 18410342 | R | A | 88 |
| 2FH21F_15_119 | 21 | 13976012 | F | A | 110 | 15 | 19264667 | R | C | 110 |
| 2FH21F_15_126 | 21 | 14329606 | F | C | 98 | 15 | 44318884 | F | T | 98 |

TABLE 4A-continued

| | | | | | | | | |
|---|---|---|---|---|---|---|---|---|
| 2FH21F_15_128 | 21 | 14329861 | R | G | 113 | 15 | 44319637 | R | A | 118 |
| 2FH21F_15_130 | 21 | 14330105 | R | C | 113 | 15 | 44319887 | R | T | 113 |
| 2FH21F_15_134 | 21 | 14330189 | R | T | 107 | 15 | 44319971 | R | C | 107 |
| 2FH21F_15_135 | 21 | 14330252 | F | A | 110 | 15 | 44320034 | F | G | 110 |
| 2FH21F_15_137 | 21 | 14330414 | F | T | 94 | 15 | 44320198 | F | C | 95 |
| 2FH21F_15_139 | 21 | 14330464 | F | T | 83 | 15 | 44320249 | F | C | 84 |
| 2FH21F_15_142 | 21 | 14330613 | F | G | 102 | 15 | 44320399 | F | G | 102 |
| 2FH21F_15_144 | 21 | 14330885 | R | T | 106 | 15 | 44320643 | R | T | 101 |
| 2FH21F_15_146 | 21 | 14331549 | R | C | 84 | 15 | 44321301 | R | A | 84 |
| 2FH21F_15_147 | 21 | 14331587 | R | C | 80 | 15 | 44321339 | R | T | 80 |
| 2FH21F_15_148 | 21 | 14331644 | R | A | 105 | 15 | 44321396 | R | G | 105 |
| 2FH21F_15_149 | 21 | 14332091 | F | C | 100 | 15 | 44321855 | F | A | 96 |
| 2FH21F_15_150 | 21 | 14332119 | R | G | 96 | 15 | 44321879 | R | A | 92 |
| 2FH21F_15_151 | 21 | 14332566 | R | G | 119 | 15 | 44322320 | R | C | 124 |
| 2FH21F_15_152 | 21 | 14332589 | R | A | 114 | 15 | 44322343 | R | T | 119 |
| 2FH21F_15_153 | 21 | 14332612 | F | G | 109 | 15 | 44322371 | F | C | 114 |
| 2FH21F_15_156 | 21 | 14333098 | R | G | 102 | 15 | 44322880 | R | C | 102 |
| 2FH21F_15_157 | 21 | 14333124 | F | A | 106 | 15 | 44322906 | F | A | 106 |
| 2FH21F_15_160 | 21 | 14333462 | R | G | 101 | 15 | 44323242 | R | G | 101 |
| 2FH21F_15_165 | 21 | 14333667 | R | A | 95 | 15 | 44323445 | R | C | 95 |
| 2FH21F_15_170 | 21 | 14334200 | F | C | 109 | 15 | 44323975 | F | G | 106 |
| 2FH21F_15_175 | 21 | 14334530 | F | G | 105 | 15 | 44324302 | F | A | 105 |
| 2FH21F_15_178 | 21 | 14334783 | R | T | 89 | 15 | 44324556 | R | A | 89 |
| 2FH21F_15_180 | 21 | 14334944 | R | G | 111 | 15 | 44324783 | R | A | 111 |
| 2FH21F_15_182 | 21 | 14335783 | F | G | 108 | 15 | 44325553 | F | A | 107 |
| 2FH21F_15_191 | 21 | 14335875 | R | T | 110 | 15 | 44325644 | R | C | 111 |
| 2FH21F_15_193 | 21 | 22732455 | F | T | 110 | 15 | 50126130 | F | A | 110 |
| 2FH21F_15_195 | 21 | 22909478 | F | T | 82 | 15 | 57893049 | F | G | 82 |
| 2FH21F_15_196 | 21 | 22909551 | R | C | 121 | 15 | 57892976 | R | G | 121 |
| 2FH21F_15_193 | 21 | 22909563 | R | G | 94 | 15 | 57892964 | R | C | 94 |
| 2FH21F_15_200 | 21 | 22909608 | F | G | 114 | 15 | 57892919 | F | A | 114 |
| 2FH21F_15_210 | 21 | 22909683 | F | C | 94 | 15 | 57892844 | F | A | 94 |
| 2FH21F_15_211 | 21 | 31354944 | R | C | 90 | 15 | 23136353 | R | T | 90 |
| 2FH21F_15_212 | 21 | 31354964 | R | C | 119 | 15 | 23136373 | R | A | 119 |
| 2FH21F_15_214 | 21 | 31354995 | F | C | 83 | 15 | 23136404 | F | T | 83 |
| 2FH21F_15_217 | 21 | 31355097 | F | G | 81 | 15 | 23150634 | F | T | 215 |
| 2FH21F_15_218 | 21 | 31355171 | F | C | 118 | 15 | 23150809 | F | A | 85 |
| 2FH21F_15_219 | 21 | 31355249 | F | G | 101 | 15 | 23152205 | F | T | 119 |
| 2FH21F_15_220 | 21 | 31355355 | R | C | 100 | 15 | 23152221 | R | C | 102 |
| 2FH21F_15_221 | 21 | 31355370 | R | C | 98 | 15 | 23153010 | R | T | 100 |
| 2FH21F_15_222 | 21 | 31355525 | F | A | 103 | 15 | 23156668 | F | A | 104 |
| 2FH21F_15_223 | 21 | 31356019 | F | C | 97 | 15 | 23156688 | F | T | 109 |
| 2FH21F_15_228 | 21 | 31356039 | F | G | 86 | 15 | 23156720 | F | C | 86 |
| 2FH21F_15_231 | 21 | 31356065 | F | G | 119 | 15 | 23167097 | F | T | 119 |
| 2FH21F_15_234 | 21 | 31356399 | R | C | 120 | 15 | 23167175 | R | T | 119 |
| 2FH21F_15_236 | 21 | 31356477 | R | C | 101 | 15 | 23167241 | R | T | 86 |
| 2FH21F_15_237 | 21 | 31356543 | R | C | 86 | 15 | 23167291 | R | C | 100 |
| 2FH21F_15_233 | 21 | 31356594 | F | T | 104 | 15 | 23167454 | F | T | 104 |
| 2FH21F_15_239 | 21 | 31356757 | F | A | 93 | 15 | 23167487 | F | T | 109 |
| 2FH21F_15_241 | 21 | 31356790 | R | G | 112 | 15 | 23167608 | R | C | 93 |
| 2FH21F_15_242 | 21 | 31356911 | F | G | 100 | 15 | 23167716 | F | A | 112 |
| 2FH21F_15_243 | 21 | 31357019 | F | G | 100 | 15 | 23167782 | F | A | 100 |
| | 21 | 31357085 | R | G | 100 | 15 | 23167784 | R | C | 100 |

TABLE 4A-continued

| | | | | | | | | | |
|---|---|---|---|---|---|---|---|---|---|
| 2FH21F_15_244 | 21 | 31357145 | F | G | 117 | 15 | 23167842 | F | 117 |
| 2FH21F_15_247 | 21 | 31357316 | R | T | 115 | 15 | 23168014 | R | 116 |
| 2FH21F_15_248 | 21 | 36589643 | F | T | 90 | 15 | 81157835 | F | 214 |
| 2FH21F_16_004 | 21 | 15052250 | F | T | 117 | 16 | 56061461 | F | 117 |
| 2FH21F_16_005 | 21 | 15052256 | R | T | 117 | 16 | 56061467 | R | 117 |
| 2FH21F_16_006 | 21 | 16577428 | F | T | 115 | 16 | 75226732 | F | 115 |
| 2FH21F_16_010 | 21 | 29192727 | F | A | 82 | 16 | 20653095 | R | 79 |
| 2FH21F_16_011 | 21 | 29192949 | F | T | 117 | 16 | 20653317 | F | 117 |
| 2FH21F_16_012 | 21 | 29192996 | R | A | 115 | 16 | 20653364 | R | 115 |
| 2FH21F_16_014 | 21 | 29193036 | R | C | 119 | 16 | 20653404 | R | 119 |
| 2FH21F_16_015 | 21 | 29193084 | F | C | 120 | 16 | 20653452 | F | 120 |
| 2FH21F_16_016 | 21 | 29196058 | F | T | 117 | 16 | 20655783 | F | 120 |
| 2FH21F_16_018 | 21 | 29197551 | F | C | 100 | 16 | 20657780 | F | 100 |
| 2FH21F_16_019 | 21 | 29197558 | R | G | 100 | 16 | 20657787 | R | 100 |
| 2FH21F_16_021 | 21 | 29197604 | R | A | 114 | 16 | 20657833 | R | 114 |
| 2FH21F_16_022 | 21 | 29197624 | F | T | 114 | 16 | 20657853 | F | 114 |
| 2FH21F_16_023 | 21 | 29197908 | R | G | 102 | 16 | 20660574 | R | 102 |
| 2FH21F_16_024 | 21 | 32671407 | F | T | 98 | 16 | 30338481 | F | 97 |
| 2FH21F_16_025 | 21 | 32671471 | F | T | 88 | 16 | 30338544 | F | 88 |
| 2FH21F_17_004 | 21 | 24615434 | R | C | 83 | 17 | 44843420 | R | 83 |
| 2FH21F_17_006 | 21 | 38532100 | F | T | 94 | 17 | 45987947 | F | 94 |
| 2FH21F_17_008 | 21 | 38532223 | R | C | 96 | 17 | 45987924 | R | 96 |
| 2FH21F_17_009 | 21 | 38532149 | F | C | 91 | 17 | 45987898 | F | 91 |
| 2FH21F_17_010 | 21 | 38532403 | R | A | 95 | 17 | 45986684 | R | 95 |
| 2FH21F_17_011 | 21 | 38532428 | F | G | 99 | 17 | 45986659 | F | 99 |
| 2FH21F_17_012 | 21 | 39486280 | R | A | 95 | 17 | 41026587 | R | 95 |
| 2FH21F_17_014 | 21 | 39486350 | R | A | 93 | 17 | 41026517 | R | 93 |
| 2FH21F_17_015 | 21 | 39486380 | F | T | 107 | 17 | 41026487 | F | 107 |
| 2FH21F_17_020 | 21 | 39486682 | F | A | 99 | 17 | 41026180 | F | 104 |
| 2FH21F_17_021 | 21 | 39486851 | R | C | 82 | 17 | 41026004 | R | 82 |
| 2FH21F_17_022 | 21 | 39486902 | R | T | 100 | 17 | 41025953 | R | 100 |
| 2FH21F_17_023 | 21 | 39486997 | F | G | 102 | 17 | 41025858 | F | 101 |
| 2FH21F_18_002 | 21 | 13567219 | R | A | 102 | 18 | 15086411 | R | 101 |
| 2FH21F_18_005 | 21 | 13583906 | F | G | 86 | 18 | 15072096 | F | 86 |
| 2FH21F_18_006 | 21 | 13585163 | F | T | 119 | 18 | 15070881 | R | 119 |
| 2FH21F_18_019 | 21 | 13585166 | R | C | 119 | 18 | 15070878 | R | 119 |
| 2FH21F_18_020 | 21 | 13607464 | R | A | 108 | 18 | 15048533 | F | 109 |
| 2FH21F_18_021 | 21 | 13608759 | F | T | 100 | 18 | 15047227 | F | 100 |
| 2FH21F_18_023 | 21 | 13609221 | R | C | 97 | 18 | 15046765 | F | 97 |
| 2FH21F_18_031 | 21 | 13613775 | F | G | 111 | 18 | 15039544 | F | 111 |
| 2FH21F_18_035 | 21 | 13676899 | F | T | 80 | 18 | 14843884 | R | 80 |
| 2FH21F_18_042 | 21 | 13677129 | R | C | 98 | 18 | 14843654 | R | 98 |
| 2FH21F_18_044 | 21 | 13678531 | F | T | 119 | 18 | 14842335 | R | 119 |
| 2FH21F_18_045 | 21 | 13678653 | F | T | 86 | 18 | 14842213 | F | 86 |
| 2FH21F_18_046 | 21 | 13678937 | F | T | 120 | 18 | 14841929 | F | 120 |
| 2FH21F_18_047 | 21 | 13679258 | R | A | 81 | 18 | 14841608 | R | 81 |
| 2FH21F_18_048 | 21 | 13679689 | F | C | 108 | 18 | 14841172 | F | 108 |
| 2FH21F_18_050* | 21 | 13679727 | R | G | 85 | 18 | 14841134 | F | 85 |
| 2FH21F_18_051* | 21 | 13680033 | F | G | 111 | 18 | 14840828 | R | 111 |
| 2FH21F_18_054 | 21 | 13680058 | F | T | 98 | 18 | 14840803 | R | 80 |
| 2FH21F_18_055 | 21 | 13680768 | R | C | 113 | 18 | 14840088 | R | 113 |
| 2FH21F_18_059 | 21 | 13680796 | R | T | 103 | 18 | 14840059 | R | 104 |
| 2FH21F_18_059 | 21 | 13686501 | R | T | 101 | 18 | 14834328 | F | 101 |

TABLE 4A-continued

| ID | Chr | Pos | Dir | Base | Val | Chr | Pos | Dir | Base | Val |
|---|---|---|---|---|---|---|---|---|---|---|
| 2FH21F_18_060 | 21 | 13686840 | F | A | 100 | 18 | 14833989 | R | C | 100 |
| 2FH21F_18_061 | 21 | 13686860 | R | G | 111 | 18 | 14833969 | F | A | 111 |
| 2FH21F_18_063 | 21 | 13687524 | F | A | 98 | 18 | 14833315 | R | C | 98 |
| 2FH21F_18_065* | 21 | 13687741 | R | A | 120 | 18 | 14833098 | F | A | 120 |
| 2FH21F_18_066 | 21 | 13688025 | F | A | 116 | 18 | 14832818 | R | C | 112 |
| 2FH21F_18_067 | 21 | 13688314 | R | A | 115 | 18 | 14832529 | F | A | 115 |
| 2FH21F_18_068* | 21 | 13688562 | F | T | 111 | 18 | 14832281 | R | G | 111 |
| 2FH21F_18_070 | 21 | 13688877 | F | C | 118 | 18 | 14831965 | R | T | 118 |
| 2FH21F_18_071* | 21 | 13689014 | F | T | 90 | 18 | 14831828 | R | G | 90 |
| 2FH21F_18_072 | 21 | 13689107 | R | C | 117 | 18 | 14831735 | F | G | 116 |
| 2FH21F_18_074 | 21 | 13689632 | F | C | 111 | 18 | 14831211 | R | G | 111 |
| 2FH21F_18_076 | 21 | 13690808 | R | T | 88 | 18 | 14830029 | F | T | 89 |
| 2FH21F_18_078 | 21 | 13691635 | F | G | 114 | 18 | 14829201 | R | T | 114 |
| 2FH21F_18_083* | 21 | 13694498 | R | G | 89 | 18 | 14826337 | F | A | 89 |
| 2FH21F_18_086* | 21 | 13695423 | F | T | 120 | 18 | 14825419 | R | G | 120 |
| 2FH21F_18_090* | 21 | 13697020 | R | C | 83 | 18 | 14823821 | F | C | 83 |
| 2FH21F_18_094 | 21 | 13706648 | F | A | 100 | 18 | 14814186 | R | C | 100 |
| 2FH21F_18_101 | 21 | 13713284 | R | G | 103 | 18 | 14807188 | F | T | 103 |
| 2FH21F_18_103 | 21 | 13714932 | F | G | 99 | 18 | 14805576 | R | A | 99 |
| 2FH21F_18_117 | 21 | 13723496 | R | A | 115 | 18 | 14718593 | F | T | 115 |
| 2FH21F_18_120 | 21 | 13724769 | F | A | 85 | 18 | 14717315 | R | C | 85 |
| 2FH21F_18_122 | 21 | 13725010 | R | A | 85 | 18 | 14717074 | F | G | 85 |
| 2FH21F_18_123 | 21 | 13732060 | F | C | 93 | 18 | 14710050 | R | C | 93 |
| 2FH21F_18_126 | 21 | 13734197 | R | G | 105 | 18 | 14707921 | F | A | 105 |
| 2FH21F_18_127 | 21 | 13734217 | F | C | 103 | 18 | 14707900 | R | T | 103 |
| 2FH21F_18_132 | 21 | 13735676 | R | C | 106 | 18 | 14706441 | F | A | 106 |
| 2FH21F_18_133 | 21 | 13736390 | F | G | 116 | 18 | 14705733 | R | T | 118 |
| 2FH21F_18_136 | 21 | 13739171 | R | C | 97 | 18 | 14702950 | F | A | 97 |
| 2FH21F_18_137 | 21 | 13739241 | F | G | 110 | 18 | 14702880 | R | T | 110 |
| 2FH21F_18_138 | 21 | 13739280 | R | C | 111 | 18 | 14702841 | F | A | 111 |
| 2FH21F_18_139* | 21 | 13739359 | F | C | 115 | 18 | 14702762 | R | G | 115 |
| 2FH21F_18_141 | 21 | 13739493 | R | T | 104 | 18 | 14702628 | F | A | 104 |
| 2FH21F_18_142 | 21 | 13739495 | F | T | 104 | 18 | 14702626 | R | T | 104 |
| 2FH21F_18_143* | 21 | 13739563 | R | C | 100 | 18 | 14702558 | F | C | 100 |
| 2FH21F_18_144* | 21 | 13740079 | R | C | 100 | 18 | 14702029 | F | T | 100 |
| 2FH21F_18_145 | 21 | 13740111 | F | A | 108 | 18 | 14701997 | R | G | 108 |
| 2FH21F_18_149 | 21 | 13740288 | R | T | 108 | 18 | 14701820 | F | A | 108 |
| 2FH21F_18_151 | 21 | 13740658 | R | A | 81 | 18 | 14701478 | F | C | 81 |
| 2FH21F_18_153 | 21 | 13740789 | F | T | 106 | 18 | 14701347 | R | G | 106 |
| 2FH21F_18_154 | 21 | 13741100 | R | T | 81 | 18 | 14701036 | F | C | 81 |
| 2FH21F_18_156 | 21 | 13741318 | F | G | 85 | 18 | 14700818 | R | A | 86 |
| 2FH21F_18_158 | 21 | 13741417 | R | A | 118 | 18 | 14700718 | F | T | 118 |
| 2FH21F_18_159 | 21 | 13741498 | F | C | 112 | 18 | 14700637 | R | C | 112 |
| 2FH21F_18_160 | 21 | 13741575 | R | T | 115 | 18 | 14700560 | F | G | 115 |
| 2FH21F_18_161 | 21 | 13741601 | F | T | 112 | 18 | 14700531 | R | G | 114 |
| 2FH21F_18_162* | 21 | 13741741 | R | A | 114 | 18 | 14700391 | F | C | 114 |
| 2FH21F_18_171 | 21 | 13746965 | R | C | 114 | 18 | 14695171 | F | G | 114 |
| 2FH21F_18_172 | 21 | 13753460 | R | C | 114 | 18 | 14688668 | F | G | 114 |
| 2FH21F_18_173 | 21 | 13753479 | F | G | 90 | 18 | 14688647 | R | A | 90 |
| 2FH21F_18_174 | 21 | 13754373 | R | A | 98 | 18 | 14687794 | F | T | 98 |
| 2FH21F_18_175 | 21 | 13754850 | F | G | 104 | 18 | 14685428 | R | A | 104 |
| 2FH21F_18_176 | 21 | 13756658 | F | C | 100 | 18 | 14672247 | R | A | 100 |

TABLE 4A-continued

| | | | | | | | | | |
|---|---|---|---|---|---|---|---|---|---|
| 2FH21F_18_186 | 21 | 13771387 | F | C | 98 | 18 | 14670492 | R | A | 98 |
| 2FH21F_18_188 | 21 | 13771486 | F | C | 111 | 18 | 14670393 | R | A | 111 |
| 2FH21F_18_190 | 21 | 13771524 | F | A | 107 | 18 | 14670355 | F | G | 107 |
| 2FH21F_18_191 | 21 | 13771649 | R | T | 90 | 18 | 14670230 | F | G | 90 |
| 2FH21F_18_194 | 21 | 13775207 | R | A | 120 | 18 | 14666674 | R | G | 120 |
| 2FH21F_18_195 | 21 | 13775250 | F | T | 119 | 18 | 14666631 | F | C | 119 |
| 2FH21F_18_197 | 21 | 13775571 | F | C | 101 | 18 | 14666302 | F | C | 101 |
| 2FH21F_18_198 | 21 | 13775577 | R | A | 101 | 18 | 14666296 | F | A | 101 |
| 2FH21F_18_199 | 21 | 13775783 | F | C | 101 | 18 | 14666090 | R | A | 101 |
| 2FH21F_18_200 | 21 | 13775825 | R | C | 85 | 18 | 14666048 | R | A | 85 |
| 2FH21F_18_201 | 21 | 13775885 | R | C | 96 | 18 | 14665988 | R | T | 96 |
| 2FH21F_18_202 | 21 | 13777903 | F | G | 96 | 18 | 14663972 | F | C | 96 |
| 2FH21F_18_203 | 21 | 13777939 | F | T | 119 | 18 | 14663936 | R | C | 119 |
| 2FH21F_18_204 | 21 | 13778733 | F | C | 96 | 18 | 14663146 | R | A | 96 |
| 2FH21F_18_212 | 21 | 13783264 | F | T | 96 | 18 | 14658612 | F | C | 96 |
| 2FH21F_18_213 | 21 | 13783324 | R | G | 100 | 18 | 14658552 | R | T | 100 |
| 2FH21F_18_216 | 21 | 13784000 | F | A | 101 | 18 | 14657872 | F | C | 101 |
| 2FH21F_18_217 | 21 | 13784009 | R | C | 101 | 18 | 14657863 | F | A | 101 |
| 2FH21F_18_219 | 21 | 13785807 | F | C | 120 | 18 | 14656075 | R | A | 120 |
| 2FH21F_18_223 | 21 | 13787653 | F | T | 83 | 18 | 14654244 | R | C | 83 |
| 2FH21F_18_224 | 21 | 13787882 | F | C | 95 | 18 | 14654015 | R | T | 95 |
| 2FH21F_18_226 | 21 | 13788781 | R | A | 100 | 18 | 14653118 | R | G | 100 |
| 2FH21F_18_233 | 21 | 13809100 | F | T | 101 | 18 | 14637715 | F | G | 101 |
| 2FH21F_18_234 | 21 | 13817921 | F | T | 110 | 18 | 14624683 | R | C | 110 |
| 2FH21F_18_241 | 21 | 13825443 | F | C | 87 | 18 | 14617161 | R | T | 87 |
| 2FH21F_18_243 | 21 | 13825600 | R | T | 108 | 18 | 14617004 | F | G | 108 |
| 2FH21F_18_245 | 21 | 13825929 | F | G | 116 | 18 | 14616676 | R | C | 116 |
| 2FH21F_18_252 | 21 | 13825963 | F | G | 116 | 18 | 14616642 | R | T | 116 |
| 2FH21F_18_254 | 21 | 13837138 | F | A | 103 | 18 | 14605452 | F | T | 102 |
| 2FH21F_18_255 | 21 | 13846782 | R | T | 92 | 18 | 14595816 | R | G | 92 |
| 2FH21F_18_260 | 21 | 13847349 | R | T | 112 | 18 | 14595239 | R | C | 112 |
| 2FH21F_18_261 | 21 | 13852890 | R | T | 120 | 18 | 14589935 | F | C | 120 |
| 2FH21F_18_262 | 21 | 13853735 | R | C | 113 | 18 | 14589078 | R | C | 113 |
| 2FH21F_18_268 | 21 | 13853770 | R | C | 107 | 18 | 14589043 | F | T | 107 |
| 2FH21F_18_269 | 21 | 13856320 | R | C | 93 | 18 | 14586489 | R | A | 93 |
| 2FH21F_18_270 | 21 | 13856700 | R | C | 83 | 18 | 14586110 | F | C | 83 |
| 2FH21F_18_271 | 21 | 13856890 | R | A | 104 | 18 | 14585922 | R | C | 104 |
| 2FH21F_18_272 | 21 | 13862329 | R | T | 105 | 18 | 14579738 | R | T | 105 |
| 2FH21F_18_273 | 21 | 13862406 | R | G | 110 | 18 | 14579661 | R | T | 110 |
| 2FH21F_18_274 | 21 | 13862436 | R | A | 116 | 18 | 14579631 | F | G | 116 |
| 2FH21F_18_275 | 21 | 13862459 | F | T | 97 | 18 | 14579608 | R | C | 97 |
| 2FH21F_18_276 | 21 | 13862500 | F | A | 106 | 18 | 14579567 | F | A | 106 |
| 2FH21F_18_277 | 21 | 13862519 | R | A | 106 | 18 | 14579548 | R | A | 106 |
| 2FH21F_18_284 | 21 | 13869305 | R | G | 102 | 18 | 14567749 | R | C | 102 |
| 2FH21F_18_292 | 21 | 13877545 | F | A | 83 | 18 | 14559499 | R | C | 83 |
| 2FH21F_18_293 | 21 | 13895590 | F | C | 98 | 18 | 14541965 | R | C | 98 |
| 2FH21F_18_296 | 21 | 13896370 | F | C | 99 | 18 | 14541176 | F | A | 99 |
| 2FH21F_18_300 | 21 | 13897380 | R | A | 111 | 18 | 14540150 | R | A | 111 |
| 2FH21F_18_301 | 21 | 13898463 | F | C | 105 | 18 | 14539060 | F | T | 105 |
| 2FH21F_18_303 | 21 | 13898498 | R | A | 118 | 18 | 14539025 | R | T | 118 |
| 2FH21F_18_304 | 21 | 13898901 | R | C | 111 | 18 | 14538622 | F | C | 111 |
| 2FH21F_18_305 | 21 | 13898938 | R | A | 110 | 18 | 14538585 | R | T | 110 |
| 2FH21F_18_305 | 21 | 13899002 | F | C | 110 | 18 | 14538521 | R | A | 110 |

TABLE 4A-continued

| | | | | | | | | |
|---|---|---|---|---|---|---|---|---|
| 2FH21F_18_307 | 21 | 13899539 | R | 95 | 18 | 14537930 | F | 99 |
| 2FH21F_18_314 | 21 | 13958107 | F | 92 | 18 | 14479443 | R | 92 |
| 2FH21F_18_319 | 21 | 14043808 | R | 90 | 18 | 14396652 | G | 90 |
| 2FH21F_18_326 | 21 | 14121932 | F | 114 | 18 | 14347928 | T | 116 |
| 2FH21F_18_327 | 21 | 14121941 | R | 109 | 18 | 14347918 | A | 111 |
| 2FH21F_18_328 | 21 | 14121971 | R | 109 | 18 | 14347887 | A | 111 |
| 2FH21F_18_329 | 21 | 14122272 | R | 110 | 18 | 14347585 | C | 111 |
| 2FH21F_18_330 | 21 | 14124875 | F | 81 | 18 | 14344986 | C | 81 |
| 2FH21F_18_332 | 21 | 14128493 | R | 81 | 18 | 14341370 | G | 81 |
| 2FH21F_18_333 | 21 | 14221264 | R | 116 | 18 | 14222905 | C | 116 |
| 2FH21F_18_340 | 21 | 14274503 | R | 114 | 18 | 14168976 | C | 114 |
| 2FH21F_18_344 | 21 | 14282925 | F | 92 | 18 | 14159539 | T | 92 |
| 2FH21F_18_346 | 21 | 14283763 | F | 116 | 18 | 14158701 | G | 116 |
| 2FH21F_18_349 | 21 | 14296262 | R | 119 | 18 | 14146201 | T | 120 |
| 2FH21F_18_350 | 21 | 14296320 | F | 119 | 18 | 14146143 | R | 119 |
| 2FH21F_18_351 | 21 | 14296558 | R | 115 | 18 | 14145905 | A | 115 |
| 2FH21F_18_352 | 21 | 14296560 | F | 115 | 18 | 14145903 | A | 115 |
| 2FH21F_18_354 | 21 | 14298284 | R | 114 | 18 | 14144184 | C | 114 |
| 2FH21F_18_355 | 21 | 14298299 | R | 105 | 18 | 14144174 | C | 105 |
| 2FH21F_18_357 | 21 | 14298722 | F | 100 | 18 | 14143752 | T | 100 |
| 2FH21F_18_364 | 21 | 14301415 | F | 119 | 18 | 14141056 | G | 119 |
| 2FH21F_18_365 | 21 | 14301450 | F | 117 | 18 | 14141021 | T | 117 |
| 2FH21F_18_369 | 21 | 14301678 | R | 106 | 18 | 14140795 | C | 106 |
| 2FH21F_18_370 | 21 | 14301937 | R | 83 | 18 | 14140537 | C | 83 |
| 2FH21F_18_375 | 21 | 14302390 | F | 118 | 18 | 14140084 | A | 118 |
| 2FH21F_18_380 | 21 | 14302721 | F | 109 | 18 | 14139753 | T | 109 |
| 2FH21F_18_386 | 21 | 14302985 | R | 104 | 18 | 14139489 | C | 104 |
| 2FH21F_18_388 | 21 | 14303062 | F | 108 | 18 | 14139412 | C | 108 |
| 2FH21F_18_398 | 21 | 14303787 | F | 117 | 18 | 14138688 | G | 117 |
| 2FH21F_18_399 | 21 | 14303884 | R | 91 | 18 | 14138591 | T | 90 |
| 2FH21F_18_402 | 21 | 14304050 | F | 100 | 18 | 14138426 | C | 100 |
| 2FH21F_18_403 | 21 | 14304106 | R | 107 | 18 | 14138370 | T | 107 |
| 2FH21F_18_405 | 21 | 14304976 | F | 117 | 18 | 14137500 | T | 117 |
| 2FH21F_18_408 | 21 | 14305188 | R | 106 | 18 | 14137291 | C | 106 |
| 2FH21F_18_409 | 21 | 14305214 | R | 101 | 18 | 14137265 | C | 101 |
| 2FH21F_18_412 | 21 | 14305608 | R | 96 | 18 | 14136938 | T | 96 |
| 2FH21F_18_414 | 21 | 14305697 | F | 101 | 18 | 14136849 | A | 101 |
| 2FH21F_18_415 | 21 | 14305767 | R | 108 | 18 | 14136779 | C | 108 |
| 2FH21F_18_417 | 21 | 14305947 | F | 115 | 18 | 14136603 | G | 115 |
| 2FH21F_18_419 | 21 | 14306173 | R | 110 | 18 | 14136378 | T | 110 |
| 2FH21F_18_427 | 21 | 14306777 | F | 115 | 18 | 14135780 | C | 115 |
| 2FH21F_18_428 | 21 | 14306802 | R | 88 | 18 | 14135755 | G | 88 |
| 2FH21F_18_429 | 21 | 14306814 | R | 88 | 18 | 14135743 | T | 88 |
| 2FH21F_18_430 | 21 | 14306846 | G | 99 | 18 | 14135711 | T | 99 |
| 2FH21F_18_432 | 21 | 14306875 | G | 98 | 18 | 14135682 | T | 98 |
| 2FH21F_18_434 | 21 | 14307078 | R | 117 | 18 | 14135479 | T | 117 |
| 2FH21F_18_435 | 21 | 14307099 | R | 118 | 18 | 14135458 | C | 118 |
| 2FH21F_18_441 | 21 | 14307877 | R | 118 | 18 | 14134766 | T | 118 |
| 2FH21F_18_446 | 21 | 14308106 | T | 92 | 18 | 14134537 | C | 92 |
| 2FH21F_18_457 | 21 | 14311562 | A | 104 | 18 | 14131075 | F | 104 |
| 2FH21F_18_459 | 21 | 14311633 | G | 101 | 18 | 14131004 | T | 101 |
| 2FH21F_18_460 | 21 | 14311656 | G | 118 | 18 | 14130981 | F | 118 |
| 2FH21F_18_461 | 21 | 14312314 | F | 103 | 18 | 14130330 | A | 103 |

TABLE 4A-continued

| | | | | | | | | | |
|---|---|---|---|---|---|---|---|---|---|
| 2FH21F_18_462 | 21 | 14312342 | F | C | 92 | 18 | 14130302 | R | 92 |
| 2FH21F_18_463 | 21 | 14312574 | R | G | 80 | 18 | 14130070 | F | 80 |
| 2FH21F_18_466 | 21 | 14312692 | F | T | 117 | 18 | 14129952 | R | 117 |
| 2FH21F_18_467 | 21 | 14312732 | R | C | 114 | 18 | 14129912 | F | 114 |
| 2FH21F_18_468 | 21 | 14313209 | F | C | 118 | 18 | 14129421 | R | 118 |
| 2FH21F_18_469 | 21 | 14313390 | R | G | 100 | 18 | 14129240 | F | 100 |
| 2FH21F_18_470 | 21 | 14313610 | F | T | 100 | 18 | 14129020 | R | 100 |
| 2FH21F_18_472 | 21 | 14313830 | R | T | 109 | 18 | 14128800 | F | 109 |
| 2FH21F_18_474 | 21 | 14313944 | F | A | 120 | 18 | 14128688 | R | 120 |
| 2FH21F_18_475 | 21 | 14314051 | R | A | 115 | 18 | 14128579 | F | 117 |
| 2FH21F_18_476 | 21 | 14314089 | F | T | 101 | 18 | 14128541 | R | 99 |
| 2FH21F_18_480 | 21 | 14314502 | F | G | 102 | 18 | 14128129 | F | 102 |
| 2FH21F_18_481 | 21 | 14314586 | F | C | 104 | 18 | 14128045 | R | 104 |
| 2FH21F_18_482 | 21 | 14314695 | F | C | 119 | 18 | 14127936 | R | 119 |
| 2FH21F_18_483 | 21 | 14314743 | F | A | 106 | 18 | 14127888 | R | 106 |
| 2FH21F_18_485 | 21 | 14314908 | F | C | 103 | 18 | 14127723 | R | 103 |
| 2FH21F_18_490 | 21 | 14315928 | R | A | 99 | 18 | 14126706 | F | 99 |
| 2FH21F_18_491 | 21 | 14316557 | F | T | 119 | 18 | 14126077 | R | 119 |
| 2FH21F_18_494 | 21 | 14316694 | R | C | 95 | 18 | 14125936 | F | 99 |
| 2FH21F_18_497 | 21 | 14317060 | F | C | 99 | 18 | 14125570 | R | 99 |
| 2FH21F_18_501 | 21 | 14318981 | F | C | 98 | 18 | 14123650 | R | 98 |
| 2FH21F_18_502 | 21 | 14319138 | R | G | 90 | 18 | 14123493 | F | 90 |
| 2FH21F_18_503 | 21 | 14321397 | F | T | 112 | 18 | 14122673 | R | 113 |
| 2FH21F_18_504 | 21 | 14321408 | R | T | 113 | 18 | 14122661 | F | 113 |
| 2FH21F_18_505 | 21 | 14321469 | F | A | 96 | 18 | 14122600 | R | 96 |
| 2FH21F_18_506 | 21 | 14321489 | R | A | 96 | 18 | 14122580 | F | 96 |
| 2FH21F_18_508 | 21 | 14321836 | F | A | 117 | 18 | 14122233 | R | 117 |
| 2FH21F_18_509 | 21 | 14321892 | R | C | 111 | 18 | 14122180 | F | 108 |
| 2FH21F_18_510 | 21 | 14322704 | F | A | 98 | 18 | 14121367 | R | 98 |
| 2FH21F_18_511 | 21 | 14322742 | R | T | 92 | 18 | 14121329 | F | 92 |
| 2FH21F_18_512 | 21 | 14322792 | F | G | 105 | 18 | 14121279 | R | 105 |
| 2FH21F_18_513 | 21 | 14322852 | R | C | 105 | 18 | 14121219 | F | 105 |
| 2FH21F_18_515 | 21 | 14322938 | F | C | 109 | 18 | 14121133 | R | 109 |
| 2FH21F_18_516 | 21 | 14323047 | R | T | 100 | 18 | 14121024 | F | 100 |
| 2FH21F_18_517 | 21 | 14323069 | F | C | 100 | 18 | 14121002 | R | 100 |
| 2FH21F_18_518 | 21 | 14323100 | R | A | 92 | 18 | 14120971 | F | 92 |
| 2FH21F_18_519 | 21 | 14323115 | F | A | 105 | 18 | 14120956 | R | 105 |
| 2FH21F_18_520 | 21 | 14323420 | R | C | 103 | 18 | 14120654 | F | 103 |
| 2FH21F_18_521 | 21 | 14324503 | F | A | 100 | 18 | 14119577 | R | 100 |
| 2FH21F_18_522 | 21 | 14324706 | R | A | 99 | 18 | 14119374 | F | 99 |
| 2FH21F_18_523 | 21 | 14324731 | F | T | 118 | 18 | 14119349 | R | 118 |
| 2FH21F_18_524 | 21 | 14324792 | R | A | 94 | 18 | 14119288 | F | 94 |
| 2FH21F_18_525 | 21 | 14324801 | F | G | 94 | 18 | 14119279 | R | 94 |
| 2FH21F_18_526 | 21 | 14324841 | R | A | 89 | 18 | 14119239 | F | 89 |
| 2FH21F_18_527 | 21 | 14324931 | F | G | 118 | 18 | 14119149 | R | 118 |
| 2FH21F_18_529 | 21 | 14327004 | R | T | 105 | 18 | 14117104 | F | 105 |
| 2FH21F_18_530 | 21 | 14327071 | F | C | 86 | 18 | 14117035 | R | 88 |
| 2FH21F_18_534 | 21 | 14327453 | R | A | 102 | 18 | 14116653 | F | 102 |
| 2FH21F_18_535 | 21 | 14327664 | F | G | 104 | 18 | 14116442 | R | 104 |
| 2FH21F_18_536 | 21 | 14327693 | R | A | 112 | 18 | 14116413 | F | 112 |
| 2FH21F_18_537 | 21 | 14327880 | F | A | 90 | 18 | 14116226 | T | 90 |
| 2FH21F_18_538 | 21 | 14327930 | R | A | 103 | 18 | 14116176 | F | 103 |
| 2FH21F_18_539 | 21 | 14328545 | F | T | 105 | 18 | 14115563 | R | 105 |

TABLE 4A-continued

| Name | | | | | | | | |
|---|---|---|---|---|---|---|---|---|
| 2FH21F_18_543 | 21 | 17841257 | R | 111 | 18 | 14469188 | F | 111 |
| 2FH21F_18_545 | 21 | 25676417 | F | 102 | 18 | 13654900 | F | 99 |
| 2FH21F_18_548 | 21 | 28291001 | F | 111 | 18 | 15073195 | F | 111 |
| 2FH21F_18_549 | 21 | 28291458 | F | 96 | 18 | 15072738 | F | 96 |
| 2FH21F_18_555* | 21 | 28308411 | R | 104 | 18 | 15055759 | F | 104 |
| 2FH21F_18_565* | 21 | 28318201 | F | 96 | 18 | 15046074 | F | 96 |
| 2FH21F_18_566* | 21 | 28318293 | F | 119 | 18 | 15045982 | F | 119 |
| 2FH21F_18_567* | 21 | 28318296 | R | 117 | 18 | 15045979 | R | 117 |
| 2FH21F_18_570* | 21 | 28318429 | F | 100 | 18 | 15045847 | R | 99 |
| 2FH21F_18_571 | 21 | 28318455 | F | 94 | 18 | 15045821 | F | 94 |
| 2FH21F_18_574* | 21 | 28318711 | R | 114 | 18 | 15045565 | R | 114 |
| 2FH21F_18_576* | 21 | 28318759 | R | 95 | 18 | 15045517 | C | 95 |
| 2FH21F_18_577* | 21 | 28318824 | R | 89 | 18 | 15045452 | F | 89 |
| 2FH21F_18_579* | 21 | 28318862 | R | 111 | 18 | 15045414 | T | 111 |
| 2FH21F_18_583* | 21 | 28319085 | R | 115 | 18 | 15045191 | A | 115 |
| 2FH21F_18_585 | 21 | 28328803 | F | 120 | 18 | 15045043 | G | 117 |
| 2FH21F_18_590 | 21 | 28349711 | F | 80 | 18 | 15040341 | C | 80 |
| 2FH21F_18_594 | 21 | 46813934 | R | 94 | 18 | 15014464 | G | 94 |
| 2FH21F_19_004 | 21 | 312108897 | R | 117 | 18 | 953658 | A | 117 |
| 2FH21F_19_005 | 21 | 312210922 | F | 120 | 19 | 53404855 | A | 120 |
| 2FH21F_19_006 | 21 | 312210930 | F | 120 | 19 | 53404880 | C | 120 |
| 2FH21F_19_007 | 21 | 312210962 | R | 120 | 19 | 53404888 | G | 120 |
| 2FH21F_19_010 | 21 | 327791147 | F | 99 | 19 | 53404920 | T | 99 |
| 2FH21F_19_012 | 21 | 33743482 | R | 80 | 19 | 7785166 | A | 80 |
| 2FH21F_19_014 | 21 | 33743785 | F | 119 | 19 | 57303531 | C | 119 |
| 2FH21F_19_015 | 21 | 33743831 | R | 115 | 19 | 57303833 | T | 117 |
| 2FH21F_19_016 | 21 | 33743853 | F | 115 | 19 | 57303881 | A | 117 |
| 2FH21F_19_018 | 21 | 33743924 | F | 120 | 19 | 57303903 | G | 120 |
| 2FH21F_19_022 | 21 | 33744128 | F | 117 | 19 | 57303974 | T | 119 |
| 2FH21F_19_026 | 21 | 33744255 | F | 83 | 19 | 57304180 | A | 82 |
| 2FH21F_19_027 | 21 | 33744286 | F | 83 | 19 | 57304303 | A | 84 |
| 2FH21F_19_028 | 21 | 33744302 | R | 87 | 19 | 57304334 | T | 88 |
| 2FH21F_19_030 | 21 | 33744768 | F | 118 | 19 | 57304351 | C | 114 |
| 2FH21F_19_031 | 21 | 33761256 | F | 106 | 19 | 57304825 | C | 102 |
| 2FH21F_20_003 | 21 | 100014053 | F | 109 | 19 | 57305651 | C | 109 |
| 2FH21F_20_004 | 21 | 100014083 | R | 109 | 20 | 51652429 | A | 109 |
| 2FH21F_20_006 | 21 | 100014138 | F | 98 | 20 | 51652459 | T | 98 |
| 2FH21F_20_007 | 21 | 100014203 | R | 105 | 20 | 51652514 | T | 105 |
| 2FH21F_20_008 | 21 | 100014238 | F | 100 | 20 | 51652579 | T | 100 |
| 2FH21F_20_009 | 21 | 100014255 | F | 100 | 20 | 51652614 | T | 100 |
| 2FH21F_20_010 | 21 | 100014324 | F | 119 | 20 | 51652631 | A | 119 |
| 2FH21F_20_011 | 21 | 100014342 | R | 118 | 20 | 51652700 | A | 118 |
| 2FH21F_20_012 | 21 | 100014428 | F | 109 | 20 | 51652718 | G | 109 |
| 2FH21F_20_013 | 21 | 100015493 | F | 89 | 20 | 51653799 | C | 89 |
| 2FH21F_20_014 | 21 | 100015509 | R | 88 | 20 | 51653864 | A | 88 |
| 2FH21F_20_015 | 21 | 100015560 | R | 106 | 20 | 51653880 | T | 106 |
| 2FH21F_20_016 | 21 | 100015572 | R | 98 | 20 | 51653931 | T | 106 |
| 2FH21F_20_017 | 21 | 100015607 | F | 98 | 20 | 51653943 | G | 98 |
| 2FH21F_20_018 | 21 | 100015618 | R | 98 | 20 | 51653978 | T | 98 |
| 2FH21F_20_020 | 21 | 100016927 | F | 116 | 20 | 51653989 | G | 116 |
| 2FH21F_22_012 | 21 | 100131022 | F | 120 | 20 | 51655279 | C | 120 |
| 2FH21F_22_016 | 21 | 100131733 | F | 100 | 22 | 41759969 | A | 101 |
| 2FH21F_22_017 | 21 | 100131740 | R | 100 | 22 | 41760983 | C | 101 |
| | | | | | 22 | 41760991 | G | 101 |

TABLE 4A-continued

| Marker_ID | Chr | PCR1 | Position | F/R | Base | Len | Len | Chr | Position | F/R | Base | Len | SEQ ID NO: |
|---|---|---|---|---|---|---|---|---|---|---|---|---|---|
| 2FH21F_22_018 | 21 | GGTTTGGATGATGTGTTGC | 10131768 | F | T | 100 | 100 | 22 | 41761019 | F | C | 100 | |
| 2FH21F_22_019 | 21 | TGATGATGGGCCAGGAAATG | 10131932 | F | A | 115 | 115 | 22 | 41761183 | F | G | 115 | |
| 2FH21F_22_021 | 21 | | 10132070 | F | A | 104 | 104 | 22 | 41761321 | F | G | 104 | |
| 2FH21F_22_025 | 21 | ATTGGCTGTAACAAATGCTG | 10132318 | R | C | 106 | 106 | 22 | 41761569 | R | T | 106 | |
| 2FH21F_22_026 | 21 | | 10132343 | F | T | 108 | 108 | 22 | 41761594 | F | G | 108 | |
| 2FH21F_22_028 | 21 | ATACCCTCCTGCATGCTTAG | 10132521 | F | A | 90 | 90 | 22 | 41761775 | F | C | 90 | |
| 2FH21F_22_029 | 21 | | 10132527 | F | A | 90 | 90 | 22 | 41761781 | F | C | 90 | |
| 2FH21F_22_030 | 21 | | 10132914 | R | G | 103 | 102 | 22 | 41762133 | R | C | 102 | |
| 2FH21F_22_035 | 21 | CAGCAAGGTTGAAATTGGGA | 10133104 | F | T | 111 | 111 | 22 | 41762322 | F | T | 111 | |
| 2FH21F_22_036 | 21 | | 10133131 | F | G | 80 | 80 | 22 | 41762349 | F | C | 80 | |
| 2FH21F_22_037 | 21 | | 10133227 | F | A | 101 | 101 | 22 | 41762445 | F | A | 101 | |
| 2FH21F_22_040 | 21 | | 10133361 | F | T | 106 | 106 | 22 | 41762579 | F | G | 106 | |
| 2FH21F_22_042 | 21 | | 10133484 | F | A | 93 | 93 | 22 | 41762702 | F | G | 93 | |
| 2FH21F_22_043 | 21 | | 10133506 | R | T | 97 | 97 | 22 | 41762724 | R | A | 97 | |
| 2FH21F_22_044 | 21 | | 10134693 | R | G | 119 | 119 | 22 | 41763868 | R | A | 119 | |
| 2FH21F_22_047 | 21 | | 10136147 | R | A | 110 | 110 | 22 | 41765342 | R | G | 110 | |
| 2FH21F_22_048 | 21 | | 10136171 | F | A | 97 | 97 | 22 | 41765366 | F | C | 97 | |
| 2FH21F_22_051 | 21 | | 10136258 | R | C | 119 | 119 | 22 | 41765459 | R | C | 119 | |
| 2FH21F_22_055 | 21 | | 10136453 | R | G | 113 | 113 | 22 | 41765655 | R | T | 113 | |
| 2FH21F_22_056 | 21 | | 10136486 | F | C | 109 | 109 | 22 | 41765688 | F | G | 109 | |
| 2FH21F_22_057 | 21 | | 10136520 | R | T | 102 | 102 | 22 | 41765722 | R | C | 102 | |
| 2FH21F_22_059 | 21 | | 10136569 | F | C | 115 | 115 | 22 | 41765772 | F | G | 116 | |
| 2FH21F_22_061 | 21 | | 10136684 | R | G | 84 | 84 | 22 | 41765887 | R | C | 84 | |
| 2FH21F_22_062 | 21 | | 10136700 | R | T | 99 | 99 | 22 | 41765903 | R | C | 99 | |
| 2FH21F_22_067 | 21 | | 10136905 | R | C | 115 | 115 | 22 | 41765490 | F | T | 116 | |
| 2FH21F_22_068 | 21 | | 10169081 | F | G | 111 | 111 | 22 | 15875667 | R | A | 111 | |
| 2FH21F_22_073 | 21 | | 10169966 | F | T | 109 | 109 | 22 | 15876544 | R | A | 110 | |
| 2FH21F_22_074 | 21 | | 10170094 | F | C | 112 | 112 | 22 | 15876672 | R | C | 112 | |
| 2FH21F_22_075 | 21 | | 10170099 | F | G | 83 | 83 | 22 | 15876677 | R | T | 83 | |
| 2FH21F_22_076 | 21 | | 10173355 | F | G | 101 | 102 | 22 | 15875914 | R | A | 102 | |
| 2FH21F_22_077 | 21 | | 10173724 | R | A | 101 | 101 | 22 | 15880283 | F | G | 101 | |
| 2FH21F_22_078 | 21 | | 10173774 | F | A | 106 | 106 | 22 | 15880332 | R | C | 105 | |
| 2FH21F_22_079 | 21 | | 10173857 | F | C | 100 | 100 | 22 | 15880415 | F | T | 98 | |
| 2FH21F_22_080 | 21 | | 10175430 | F | A | 118 | 118 | 22 | 15881989 | F | G | 119 | |
| 2FH21F_22_081 | 21 | | 10175471 | R | T | 118 | 118 | 22 | 15882030 | R | C | 119 | |
| 2FH21F_22_082 | 21 | | 10175474 | R | G | 118 | 118 | 22 | 15882034 | R | T | 119 | |
| 2FH21F_22_085 | 21 | | 10176077 | F | C | 99 | 99 | 22 | 15882635 | F | T | 99 | |

| Marker_ID | SEQ ID NO: | PCR1 | PCR2 | SEQ ID NO: | Extension | SEQ ID NO: |
|---|---|---|---|---|---|---|
| 2FH21F_01_003 | 2 | | CCTTGAGAAACTAAGTGACC | 1254 | TAAGTGACCTGCTTCTCAGCTGT | 2506 |
| 2FH21F_01_006 | 3 | | GCTGTCTAATAGAAGCTTAC | 1255 | TGTTACAGCCAATATTTAAGGA | 2507 |
| 2FH21F_01_007 | 4 | | CACTCAAGTTCCCTCTTGC | 1256 | CTCTTGCTGTCTAATAGAAGCTTAC | 2508 |
| 2FH21F_01_009 | 5 | | TCCAAGTCCTCTTAAAGGAG | 1257 | TTTTACCAGTGCTCCCC | 2509 |
| 2FH21F_01_010 | 6 | | GGGCCAGTACCATTTCATAG | 1258 | ATAGAATGCCCATTTGTG | 2510 |
| 2FH21F_01_011 | 7 | | GCAAGGTTGAAATTGGGAATG | 1259 | TCAGAAGAAAATAGGCCA | 2511 |

TABLE 4A-continued

| | | | | |
|---|---|---|---|---|
| 2FH21F_01_012 | TCATAGAATGCCCATTGTG | 8 | TTCAGCAAGGTGAAATTGG | 1260 | CAAGGTTGAAATTGGGAATGT | 2512 |
| 2FH21F_01_013 | GCCTTATCCTGTATCCTAGC | 9 | CATTCCCAATTCAACCTTGC | 1261 | TTCAACCTTGCTGAAAAA | 2513 |
| 2FH21F_01_014 | TCCCAATTTCAACCTTGCTG | 10 | TGCCAGCCTTATCCTGTATC | 1262 | TGTATCCTAGCTGTTCTTAA | 2514 |
| 2FH21F_01_015 | TGTAAGATTTTGTTCCCTC | 11 | GCTAGCTATTCCAGTTTGAA | 1263 | TTGAAAATCTACCAAACTGTAA | 2515 |
| 2FH21F_01_017 | CACCTAGCTTGAGAAGGATG | 12 | TGAGGGACAAAATCTTAC | 1264 | GGAACAAAATCTTACAAAGG | 2516 |
| 2FH21F_01_018 | CACCTAGCTTGAGAAGGATG | 13 | TGAGGGACAAAATCTTAC | 1265 | GGGATTAGGCACTCGCT | 2517 |
| 2FH21F_01_020 | AAGAAGTTCTTCTGGGTCTG | 14 | CTTCATGCTGGAGTAATGGG | 1266 | GGGTAACATATCTTTGGTATGGTT | 2518 |
| 2FH21F_01_021 | TTTTCATACACTTCTCTGG | 15 | CCCATTACTCCAGCATGAAG | 1267 | GTGGCAAAATACCTCAAGA | 2519 |
| 2FH21F_01_022 | CAGTGGCAAAATACCTCAAG | 16 | TTTTTACCATTAGTGGTTTG | 1268 | ATTTTTCATACACTTCTCTGG | 2520 |
| 2FH21F_01_023 | CAGTGGCAAAATACCTCAAG | 17 | TTTTACCATTAGTGGTTTG | 1269 | ACCATTAGTGGTTTGATTTTAAT | 2521 |
| 2FH21F_01_025 | CTCCCTCCCAGTAGAAATA | 18 | ATCCAAGATACTCACTTTCC | 1270 | ACTCACTTTCCATTAATTCTGTGT | 2522 |
| 2FH21F_01_026 | ATCCAAGATACTCACTTTCC | 19 | CTCCCTCCCCAGTAGAAATA | 1271 | TTTGTTACTTTTCTTTTTCCCCC | 2523 |
| 2FH21F_01_027 | CTTTCATTGCAAAATGTTTCC | 20 | CATTTCAAAATCTCTGGCCC | 1272 | GTTTATTAATGCAGAGCTCTC | 2524 |
| 2FH21F_01_029 | AGATTCTCTGGTCACAGG | 21 | TATCTGGTAAGAAATGTG | 1273 | TCTCAGAATTTCCCTGG | 2525 |
| 2FH21F_01_030 | GAGGCAACTAGGACTTAAGG | 22 | GTACTCAAATCAAATTGGC | 1274 | TACTCAAATCAAATTGGCTTACTTGC | 2526 |
| 2FH21F_01_031 | GTACTCAAATCAAATTGGC | 23 | GAGGCAACTAGGACTTAAGG | 1275 | GCCAACATCCATGAAAAACAA | 2527 |
| 2FH21F_01_033 | GGTGAAGGCTGTATTTGTAG | 24 | CCAGCCAAGAATACAAACAC | 1276 | CCAGCCAAGAATACAAACACAAAATA | 2528 |
| 2FH21F_01_034 | CCAGCCAAGAATACAAACAC | 25 | GGTGAAGGCTGTATTTGTAG | 1277 | TGATGTTTTCTTATTCTCCTTA | 2529 |
| 2FH21F_01_036 | CCAGCCAAGAATACAAACAC | 26 | GTAGGTGAAGGCTGTATTTG | 1278 | GGTGAAGGCTGTATTTGTAGTAGTA | 2530 |
| 2FH21F_01_037 | ATTAAGAAGTTTGCTGAGGC | 27 | CATTGGCCTTAACTCCAGAG | 1279 | GCCTTAACTCCAGAGTTTTCT | 2531 |
| 2FH21F_01_038 | CATTGGCCTTAACTCCAGAG | 28 | GCTATTAAGAAGTTTGCTGAG | 1280 | TTTGAAGCTATTCCCG | 2532 |
| 2FH21F_01_039 | AGAACTTTGAAAGTATTAAC | 29 | GCTCTACAGACAATCTGATG | 1281 | CATAGAAAGGGCAGTAGA | 2533 |
| 2FH21F_01_040 | GCTATTTGCTGATACTGGTGC | 30 | AATGAAGAGCCATGTCTGCC | 1282 | GTCTGCCACTTTGCCACCTGTTACTAC | 2534 |
| 2FH21F_01_041 | GGAACAGTGTTGATAAAGACT | 31 | CACCAGTATCAGCAATAGCTT | 1283 | ACCAGTATCAGCAATAGCTTTGACTT | 2535 |
| 2FH21F_01_043 | AGCTTGCCATCTCTACTTCC | 32 | GAAGTCTCATCTCTACTTCG | 1284 | CATCTCTACTTCGTACCTC | 2536 |
| 2FH21F_01_044 | GCAGAAAAGCTCATGAGATTC | 33 | GTACGAAGTAGAGATGAGAC | 1285 | GAAGTAGAGATGAGACTTCATCAA | 2537 |
| 2FH21F_01_045 | GCAGAAAAGCTCATGAGATTC | 34 | GTACGAAGTAGAGATGAGAC | 1286 | AGTTTTTTGCAGAAACAAC | 2538 |

TABLE 4A-continued

| | | | | |
|---|---|---|---|---|
| 2FH21F_01_046 | 35 | ATCTCGAAGGTTTTTGCAG | AGTCATAGAAGGTTATG | 1287 | GGTCATAGAAGGTTATGAAATAGC | 2539 |
| 2FH21F_01_049 | 36 | CATTCATCAGAATGTGACCC | CATTACCCCCTTATTATTTTG | 1288 | AAGATTTTCCTCCCTCCT | 2540 |
| 2FH21F_01_050 | 37 | CATTACCCCCTTATTATTTTG | CATTCATCAGAATGTGACCC | 1289 | AGGAGGAGGAGAAAATCTTTAA | 2541 |
| 2FH21F_01_057 | 38 | AGTCGGAGTCATACTCCAAG | GCTAAAGTCCTTCTTCTAC | 1290 | CTCCTTCTTCTACCCACAGA | 2542 |
| 2FH21F_01_058 | 39 | CTGTGTAAGAAGACGAAGC | GGATGGGAGATCTGCTAAAC | 1291 | TTGATCGCCTTAATCTGA | 2543 |
| 2FH21F_01_059 | 40 | GGATGGGAGATCTGCTAAAC | CTGTGTAAGAAGACGAAGC | 1292 | CGATCAAGAACACCCTT | 2544 |
| 2FH21F_01_060 | 41 | AGGTGCAGGCTTTAGGTTTG | GATAAGGCTCAATTACTTG | 1293 | AGGCTCAATTACTTGAAATAGC | 2545 |
| 2FH21F_01_062 | 42 | TAATGCAGCTGCCATGTGTG | TATAGTAGGTGGAGGTGCAG | 1294 | GGTGGAGGTGCAGGCTTTAGGTTTGG | 2546 |
| 2FH21F_01_063 | 43 | CTCAGTTAGTTCTTCTATAGT | AAACCTAAAGCTGCACCTC | 1295 | GAGAAAGTTGCTAAAAGTCA | 2547 |
| 2FH21F_01_064 | 44 | ATTGCTCAGCAAAACCA | GAGATCCAGATGATACAGGG | 1296 | TGATACAGGGAATTCTTTTGTTAA | 2548 |
| 2FH21F_01_065 | 45 | CATTCTCCATAAACACTATC | GAATTCCCTGTATCATCTGG | 1297 | TATCATCTGGATCTCAACAT | 2549 |
| 2FH21F_01_067 | 46 | CTCTACAGCAATGAGTGAAC | CCTGAGCTCTATTTAACATGC | 1298 | TGCATTCTCACTGAGTCTTTCTGAGC | 2550 |
| 2FH21F_01_068 | 47 | CCTGAGCTCTATTTAACATGC | TACAGCAATGAGTGAACGGG | 1299 | AGACTCAGTGAGAATGCATTGA | 2551 |
| 2FH21F_01_071 | 48 | TCAGGGCCACTATCATGAC | AGCAAACATCCTGTGTCTG | 1300 | GTGTCTGCTTTGATGGA | 2552 |
| 2FH21F_01_072 | 49 | TCCTGTGTCTGCTTTGATGG | TCAGGGCCACTATCATGAC | 1301 | CAGGTGGTTGCCACCTCT | 2553 |
| 2FH21F_01_073 | 50 | TTATAAACCTCAATCTATC | CAATGGGCCTTGTACCAAAG | 1302 | CTCATGCTAATGCCAC | 2554 |
| 2FH21F_01_077 | 51 | GGTACAAAATCAAAGCCTG | GGCAATTTAAGACATTGTG | 1303 | AGACATTGTGTAAAAGCAATCTGTA | 2555 |
| 2FH21F_01_078 | 52 | TCGTTTGGATGTTAGCCAC | AACCATACAGGGTTTTGTA | 1304 | GGTTTTGTATGTTTATATTGTTTA | 2556 |
| 2FH21F_01_080 | 53 | AGTGGCTAACATCCAAACGA | TTAACATTCCACACTGAAG | 1305 | CATTCCACACTGAAGATTACTCT | 2557 |
| 2FH21F_01_081 | 54 | GTACTATGATGTAACTCCCC | CACAGCCCTTCACTGATTAC | 1306 | TTACAGCAAGTGTTACAGTAG | 2558 |
| 2FH21F_01_082 | 55 | GTAATCAGTGAAGGGCTGTG | GATCACCTCAATAACACTGG | 1307 | ATCTGTCCAGACAGAACCCA | 2559 |
| 2FH21F_01_083 | 56 | CTTGATCACCTCAATAACAC | GTAATCAGTGAAGGGCTGTG | 1308 | GTTCTGCTGGACAGATA | 2560 |
| 2FH21F_01_084 | 57 | CAAAATTTTGAGGGGAGATGG | TGGGTTCTGCTGGACAGATA | 1309 | AGTGTTATTGAGGTGATCAAG | 2561 |
| 2FH21F_01_086 | 58 | TGGGTTCTGCTGGACAGATA | CCTCTACAAAATTTTGAGGG | 1310 | CAAAATTTTGAGGGGAGATGGT | 2562 |
| 2FH21F_01_088 | 59 | GTAAACTATATCACAACTC | GGGTCATAAGAAGGGAGTAA | 1311 | AGGGAGTAAAAATGAAGTCTGA | 2563 |
| 2FH21F_01_090 | 60 | GTGGCTGGTTGCCAATTTTA | TGAATTTCAGTGCCACCTAG | 1312 | CAGCTACACCTAGATGAC | 2564 |

TABLE 4A-continued

| | | | |
|---|---|---|---|
| 2FH21F_01_093 | ATTGGCAACCAGCCACTATT | TACCACTGTAATACACATG | 61 | CCACTGTAATACACATGAAATAT | 1313 | 2565 |
| 2FH21F_01_094 | ATTTGGGCCTTAAGCTTTTG | TTCATGTGTATTACAGTGG | 62 | ATTACAGTGGTATTCATATGCTATGT | 1314 | 2566 |
| 2FH21F_01_099 | CTGTTGTAAGGGGAAAAGTC | ACTGCTCACTGACAGCTTCT | 63 | CTGACAGCTTCTCTGTAA | 1315 | 2567 |
| 2FH21F_01_101 | GAGGCTCAGTAGAGGTTTAG | CAGAACATAGGTTTGAAGC | 64 | GGTTTGAAGCAGTCACA | 1316 | 2568 |
| 2FH21F_01_102 | CATAGGTTTGAAGCAGTCAC | GAGGCTCAGTAGAGGTTTAG | 65 | CTCAGTAGAGGTTTAGTATGATG | 1317 | 2569 |
| 2FH21F_01_104 | ACAGTGTCCTGATTAGTGCC | TGCCAGACTGGTTTGTTAGC | 66 | TTGTTTCTTAGTGCTCTAGCCAT | 1318 | 2570 |
| 2FH21F_02_003 | AATTTTATAGAGAAGCCTG | GTGTCTCATAGTCACTGTC | 67 | CATAGTCACTGTCCATAGTAAGTAT | 1319 | 2571 |
| 2FH21F_02_007 | CACCTTACCCTGCCATCAAG | CCATTCTTGCAACAGTTCCC | 68 | AGTTCCCAGAAAGAAGAGGATGTG | 1320 | 2572 |
| 2FH21F_02_015 | CATAGGTGAGAAAAGTTTGGG | GGGAAAAAAGTGCACCT | 69 | AAAAAGTGCACCTTTTCTTA | 1321 | 2573 |
| 2FH21F_02_017 | CTCTTCCAGAGTGTTCTCTA | CATAGGTGAGAAAAGTTTGGG | 70 | TGGGGAAAGAACTTGAA | 1322 | 2574 |
| 2FH21F_02_018 | CCCTACACTCCTCTTCTTT | TTCCCCAAACTTTTCTCACC | 71 | CCAAACTTTTCTCACCTATGTTT | 1323 | 2575 |
| 2FH21F_02_019 | TTCCCCAAACTTTTCTCACC | CCCTACACTCCTCTTCTCTT | 72 | CTTCTTCTTTATAGGAACACATTGC | 1324 | 2576 |
| 2FH21F_02_020 | CTCACTGTACATCCATCCTC | AAAGAAGAAGGAGTGTAGGG | 73 | TTTAGCTCTAGAGGATGAG | 1325 | 2577 |
| 2FH21F_02_021 | AAAGAAGAAGGAGTGTAGGG | CTCACTGTACATCCATCCTC | 74 | ACATCCATCCTCCAAACTG | 1326 | 2578 |
| 2FH21F_02_022 | GCAGAGATATCATGCACA | TAGTGAGGGCTTTTTCCAC | 75 | GCTTTTTCCACCTTGAA | 1327 | 2579 |
| 2FH21F_02_023 | GGCTAGGGCTTTCTTGCT | ACCCCATGTAAACCTTGAGC | 76 | TTGAGCACACTGCAAAGTCAT | 1328 | 2580 |
| 2FH21F_02_027 | GCCTCTCAGGCACCATTCT | TTATCACGTGACTTCAGTGG | 77 | CAGCTCCCCTACATACC | 1329 | 2581 |
| 2FH21F_02_034 | CCATTGCCAAAGTTGTGGTT | GTGGAATTCTCCTTGGACTC | 78 | GGAATTCTCCTTGGACTCTTTTGTCTC | 1330 | 2582 |
| 2FH21F_02_035 | GAGTCCAAGGAGAATTCCAC | ATACTCTTATCCAGTTCAGC | 79 | CTCTTATCCAGTTCAGCTTTGTTGTC | 1331 | 2583 |
| 2FH21F_02_036 | TGGTGACAAGGTGAAAAGGG | GGAGGAGATATGGTGCAGAG | 80 | GAGGAGATATGTGCAGAGCTCAG | 1332 | 2584 |
| 2FH21F_02_037 | CATAAGCCACTTTTTCAGA | CTCTTCAAATGCACCTAGTG | 81 | TTCAAATGCACCTAGTGTCACAAGAA | 1333 | 2585 |
| 2FH21F_02_038 | AAGCACCTTGGGAATTTTT | GGAAAGGGAAAAAAACCTGC | 82 | GGAAAGGGAAAAAAACCTGCCAGCCATA | 1334 | 2586 |
| 2FH21F_02_040 | ACACAGATTCCTCCCATAGC | TCCAGAAGGAGGCCCTGGT | 83 | CCAGAAGGAGGCCCTGGTGTACTA | 1335 | 2587 |
| 2FH21F_02_041 | TTGTGGAGTAGGCATATTTC | TTTTTAATCAGAATCATAGAG | 84 | CAGAATCATAGAGTAAAAATTGC | 1336 | 2588 |
| 2FH21F_02_043 | GGGATTCCATTATCTGTC | GAAACTCTAGAAAAACCCAG | 85 | AAATATGCCTACTCCACAA | 1337 | 2589 |
| 2FH21F_02_045 | CCTGAGTTTAAGTGTGCCACAT | ACAAGTCTGAGAGCCTAAAG | 86 | GAGCCTAAAGGCAGGATGTG | 1338 | 2590 |
| 2FH21F_02_050 | AGACTTTTTGTACAGTAAG | GAGTGTGTCACTTAAGGTC | 87 | TGTCACTTAAGGTCTTAGACTG | 1339 | 2591 |

TABLE 4A-continued

| | | | | | |
|---|---|---|---|---|---|
| 2FH21F_02_055 | GTTTTCTAATTTTCTGGATG | 88 | ATAGCACTAACAGCTCAAGG | 1340 | CTAACAGCTCAAGGAATGTAT | 2592 |
| 2FH21F_02_057 | CAGTGGAATCCTGGGAAATT | 89 | GCCATTACCTGCAACCATGT | 1341 | CTGCAACCATGTTGTTTTATT | 2593 |
| 2FH21F_02_058 | AAACTAACAGCCTGGAATAC | 90 | AACATGGTTGCAGGTAATGG | 1342 | ACATGGTTGCAGGTAATGGCAACAAG | 2594 |
| 2FH21F_02_061 | CTAATTTTTAGAAAGAGTAC | 91 | ATTTGTACAGTTTCCCATTCC | 1343 | CCATTCCCATTCCCACCTTT | 2595 |
| 2FH21F_02_062 | AGTGGCAGAAGATGGAATAG | 92 | TATGGTGCTAAAAAGGACTG | 1344 | TGCTAAAAAGGACTGTTATCTAA | 2596 |
| 2FH21F_02_063 | TATGGTGCTAAAAAGGACTG | 93 | AGTGGCAGAAGATGGAATAG | 1345 | GGAATAGTACAATAAGATAAGGA | 2597 |
| 2FH21F_02_065 | ACTATTCCATCTTCTGCCAC | 94 | TTTATTAAATCAGTCTGGG | 1346 | AATCAGTCTGGGAAGGCA | 2598 |
| 2FH21F_02_066 | ACATCATATAGAAAGGGCAG | 95 | GTATAACATTATACAGAGAGG | 1347 | TATACAGAGAGGACAGTGGTAAACT | 2599 |
| 2FH21F_02_067 | CAAACTGTAAACAGTGGTCC | 96 | ACTGCTGCCCTTTCTATATG | 1348 | GCTGCCCTTTCTATATGATGTAAT | 2600 |
| 2FH21F_02_072 | TTTAGAGCTCTTGCATCTTG | 97 | TCAAATGTGAGGAAAGTGCC | 1349 | ACATAAAAATGTTACCAAACAGATGGG | 2601 |
| 2FH21F_02_073 | TGGCACTTTCCTCACATTTG | 98 | GTGCCAGAACATTCTGAATC | 1350 | GAATCTTAGTGTGGAAAAAAAAA | 2602 |
| 2FH21F_02_074 | GAAAAAAGTGCATGTCTTTG | 99 | GGGAAAGATTATGATGCAC | 1351 | GAAAAGATTATGATGCACTGGCCTG | 2603 |
| 2FH21F_02_075 | AGATTATGATGCACTGGCCT | 100 | GAAAAAAGTGCATGTCTTTG | 1352 | GATGAATGCAGTGAAGTC | 2604 |
| 2FH21F_02_076 | GAAAAAGTGCATGTCTTTG | 101 | GATTATGATGCACTGGCCTG | 1353 | ACTTCACTGCATTCATCAGC | 2605 |
| 2FH21F_02_077 | GATTATGATGCACTGGCCTG | 102 | ATTATGAAAAAGTGCATGT | 1354 | AAAAAAGTGGGTTCTAGAAAAAAAA | 2606 |
| 2FH21F_02_088 | ATTAATACAAGGGGGTGTTC | 103 | CTTAAAATTAGGGATCAGA | 1355 | TAGGGATCAGAATCTCAAC | 2607 |
| 2FH21F_02_089 | G-CTACCAAACTACAATTAG | 104 | CTGAAGAAGTGTAAAATGGC | 1356 | GGCAACATGCATATAGAG | 2608 |
| 2FH21F_02_090 | GCATGTTGCCATTTTTACAC | 105 | TTGTCCCTAGGCACAAATGG | 1357 | TTAGGCACAAATGGAAATAGT | 2609 |
| 2FH21F_02_091 | CCAAATTTTCAAGCAAAGC | 106 | GTGCCTAAGGACAACTTTTC | 1358 | GACAACTTTTCTTTTTTCTTCT | 2610 |
| 2FH21F_02_103 | GGAGTTGACAATTACATCT | 107 | AAACAATGGGTTCTAGAAA | 1359 | AAACAATGGGTTCTAGAAAAAAAAA | 2611 |
| 2FH21F_02_107 | GGAAAGTTAGAAGGCCACAC | 108 | CCCAGATGAAGGGGTTTTAG | 1360 | TTTTAGTATTGAATTAGTGCTTAG | 2612 |
| 2FH21F_02_108 | GATTGTGGGTTTTTGGAAAG | 109 | ACTAAAACCCCCTTCATCGG | 1361 | CCCCTTCATCTGGGACTCAA | 2613 |
| 2FH21F_02_111 | CTTTTCCAAAAACCCACATC | 110 | CTGCTAACTCAGATACCTGC | 1362 | CTCAGATACCTGCATGTCA | 2614 |
| 2FH21F_02_113 | TGTCTCTGGCATTCCCTATC | 111 | CTTCTATCAGCAAGTTAG | 1363 | TTTTGTTTCATTTTTGTCACAT | 2615 |
| 2FH21F_02_116 | AGGGGCTGCAGGGACAGTAG | 112 | GTCTCACATCCCATTTACAG | 1364 | ATTTACAGTTTATGTCAGCTAC | 2616 |
| 2FH21F_02_127 | GTTTGCCAGTTCAAATTCAGC | 113 | CTAGCAAAGAATAATCATATC | 1365 | TAGCAAAGAATAATCATATCATTTC | 2617 |

TABLE 4A-continued

| | | | |
|---|---|---|---|
| 2FH21F_02_129 | TAGTGATATGAAGATCACA | CCATGCTGAATTTGAACTGG | 114 | AACTGGCAAACTCTGAT | 2618 |
| 2FH21F_02_132 | TAGTCATAGGTGTCCTATGG | AATACTGATAATTTGCAGC | 115 | AGAACAGGACATTAAAAAAA | 2619 |
| 2FH21F_02_134 | CTGAATAATTAAAACTTTGGC | CCCATAGACACCTATGAC | 116 | AGGACACCTATGACTAGAA | 2620 |
| 2FH21F_02_139 | GAAAGAAAGGTGCTCTACAG | AATGAATCTGCCAGATCTGT | 117 | AATGAATCTGCCAGATCTGAATGA | 2621 |
| 2FH21F_02_143 | GGCAATGAGTTCCATAAGTT | TCTGATTTATACTGAGGAC | 118 | AGGACAAATTAAAGAAAGTAATTAT | 2622 |
| 2FH21F_02_144 | TCTGATTTATACTGAGGAC | GGCAATGAGTTCCATAAGTT | 119 | GAGTTCATAAGTTACTCTTC | 2623 |
| 2FH21F_02_145 | TCTCGTCACTGCACAGG | ACAAACGCTGCACCTTGCAC | 120 | CACACCTGGGTCCTGC | 2624 |
| 2FH21F_02_146 | CACACCTGGTTGTCAGCAC | GGAGCTGAGAATGACAGTTG | 121 | CAGTTGTTAAGCAGAC | 2625 |
| 2FH21F_02_148 | TTGTTGCTCCAAGTTTAAG | AAGACCAAGATTCAGAGAC | 122 | GCAGGGCTATGCGGGAG | 2626 |
| 2FH21F_02_150 | GATTATTTTGGTACTAACAA | GAAATGAAGTGCAGGAAAGC | 123 | AAATGAAGTGCAGGAAAGCCCTGTG | 2627 |
| 2FH21F_02_151 | GGCCGGGGCCAGGGCTTT | CAATCACCACAAACTCCGGC | 124 | CCCACGGCGGGCCTCACC | 2628 |
| 2FH21F_02_155 | TGCCAAACAGCAGACGCAG | CAGCATCGCTGCCTTCTTG | 125 | AGCTCGGGCGCCCCACC | 2629 |
| 2FH21F_02_156 | TGACAGAGAAGGGCTGCAAG | AAGAAGGCAGCGATGCTGG | 126 | CATCTGCCCATCCCATCTGC | 2630 |
| 2FH21F_02_157 | GGAGAAACTGACAGAGAAGG | TCCATCTGCCCATCCCCATCT | 127 | TCCACACCGCCCTGC | 2631 |
| 2FH21F_02_158 | CCCGATGGGAACTCTCATTT | CAGCCCTTCTCTGTCAGTTT | 128 | TCTCTGTCAGTTTCTCCAT | 2632 |
| 2FH21F_02_159 | AGCCCTTCTCTGTCAGTTTC | CCCGATGGGAACTCTCATTT | 129 | GGAACTCTCATTTATCACCAAACCA | 2633 |
| 2FH21F_02_163 | ATGGCTAGGATGCCCCAGAC | TCTGAACCCTTAGTTAGGAC | 130 | GGGCCCTCCTTTCCACTTC | 2634 |
| 2FH21F_02_168 | GGTGGTGGGCAGCATCTGG | ACTTCACCGGATGATCTGGG | 131 | CGCGCGGAGTGTGGAAGAAA | 2635 |
| 2FH21F_02_170 | AAGGATAGAACAAGGTCCCG | ATCCAGCCATCCACGCTCAG | 132 | CCTCCCCCCTCGCTCTC | 2636 |
| 2FH21F_02_172 | GGGACATTATTAGCAAGGAG | AAAAGTCCTCAGGACCTGCC | 133 | AAAACGCCCTGTGAGCTCTCC | 2637 |
| 2FH21F_02_173 | CAGGGTCCTTTTCTTTTGGG | CAAAACGCCCTGTGAGCTCT | 134 | CTCTCCTTGCTAATAATGTCCCACA | 2638 |
| 2FH21F_02_174 | TCAGGAAGAAACAGTCAGGC | ATGAAAGTGGCCCCCTGCTC | 135 | GCTCCACCTGCCGAGTC | 2639 |
| 2FH21F_02_175 | TTCCAGCCTGAGGCTGTTTC | TCCTCAGACTCTCCCCTTG | 136 | GGGCAGGGAAACCTGCCG | 2640 |
| 2FH21F_02_177 | CCATTGAAGCATTCAGCAGG | AAGGGAGGCTGCCCAGGAC | 137 | CTGTGGGGCGGGGCTGGTC | 2641 |
| 2FH21F_02_178 | AGCAAGGGAGGCTGCCCAG | CCATTGAAGCATTCAGCAGG | 138 | GACCAGCCCCGCCCCACAGG | 2642 |
| 2FH21F_02_181 | AGTGTCTGCAGTTTTCTGGG | GGATGAGCAGCTCGCAATAG | 139 | GCTCGCAATAGGCCCCC | 2643 |
| 2FH21F_02_182 | GATGAGCAGCTCGCAATAGG | AGTGTCTGCAGTTTCTGGG | 140 | CTGGGGTGCCCCGTCCTC | 2644 |

| | | | |
|---|---|---|---|
| 2FH21F_02_184 | CTCTCCGGCCAGGCCTCTC | 141 | TGACCCAGATTCCTGAAGAG | 1393 | GGGCCTGGATGCTGGGTG | 2645 |
| 2FH21F_02_185 | CTCTCCGGCCAGGCCTCTC | 142 | TGACCCAGATTCCTGAAGAG | 1394 | CCAGATTCCTGAAGAGGGGATGACTA | 2646 |
| 2FH21F_02_189 | TCTTAAGCCCTTGCCCCTG | 143 | GGAAGAGCGTGGAGCAAGA | 1395 | GAGCAAGAGGAGGAGGCTCGGCCCAG | 2647 |
| 2FH21F_02_190 | GATCCCTATCTCTGTCTGCG | 144 | GTCTCAATCTGTTGGCCAG | 1396 | GGCCAGTTTATGAAAGTCAAGCCTA | 2648 |
| 2FH21F_02_191 | AGAGATAGGGATCGCTCCAG | 145 | TGGGTGTTCTGCAGGCTGG | 1397 | GGGTGGAGGTGCTCCAGGACT | 2649 |
| 2FH21F_02_193 | TCATGTGGGGCTGGTGTAG | 146 | CCACCCCCACCCCGTCAC | 1398 | CCCACCCCGTCACGCGCAT | 2650 |
| 2FH21F_02_194 | AGGAGGAGGAGCCCACACTG | 147 | AGACACTGACCCCCAGAGAC | 1399 | CTGGTGTAGGCTGGGGTGGAC | 2651 |
| 2FH21F_02_195 | GGTCAAAGGTCCTGCACAC | 148 | TACACCAGCCCCACATGAG | 1400 | GTCTCTGGGGGGTCAGTGTCTG | 2652 |
| 2FH21F_02_200 | CAAGAGTTCAGATGAGTGGC | 149 | TCCTCCAGGACTGGCCAAGT | 1401 | CCCCAGGCTCCTCCCCC | 2653 |
| 2FH21F_02_204 | GGAGTGCTTTCTTTGCAACT | 150 | CAAACATTATTTTGATTGGC | 1402 | TTTTGATTGGCCTCACAAG | 2654 |
| 2FH21F_02_206 | AAGGAAATCAGCAGTGATA | 151 | GGTGTTAACATTTAGAACAG | 1403 | AACATTTAGAACAGTACTTGTAA | 2655 |
| 2FH21F_02_207 | TGGCTGAAGGAAGCCCGAAT | 152 | GCTGGGCATATGCTGTCAGGA | 1404 | TGCTGTCAGGATTTCCA | 2656 |
| 2FH21F_02_203 | TTTGTCAATCAGCTGGAGGG | 153 | TATCTGTTTCGTTTCTAGGG | 1405 | GCTTCCTTCAGCCAGTC | 2657 |
| 2FH21F_02_211 | CCCTTCAGCTGATTGACAAA | 154 | TCCTATTGCATTGAGCATGG | 1406 | GCATGGTGATCTGGAGCTAG | 2658 |
| 2FH21F_02_212 | GAAGTACTGGTACAAGCTAT | 155 | TGCTGTTCAAAAACTGGCCC | 1407 | TGGCCCCAAGGGTAGCAATGATTGAT | 2659 |
| 2FH21F_02_213 | CAGTGAAGAGACCCCTTAGAG | 156 | CAATCATTGCTACCCTTCGG | 1408 | GCCAGTTTTTGAACAGCATA | 2660 |
| 2FH21F_02_214 | CAATCATTGCTACCCTTCGG | 157 | GGGTGTACAGTGAAGAGAC | 1409 | GTGAAGAGACCCTTAGAG | 2661 |
| 2FH21F_02_215 | CAGCTATCCCTCCAGAGTC | 158 | TCGGGCCAGTTTTTGAACAG | 1410 | CTTCACTGTACACCCCA | 2662 |
| 2FH21F_02_216 | GCCATCAAAGCCAAACTGTTC | 159 | GTCTCTTCACTGTACACCCC | 1411 | AGGGACTCTGGAGGGGATAGCTG | 2663 |
| 2FH21F_02_217 | CAGAACAGTTGGCTTTGATG | 160 | CAGCATGAAGACCTCATCTG | 1412 | AAGACCTCATCTGCAGAAA | 2664 |
| 2FH21F_02_218 | TAATGCCTCACTGAAAGCC | 161 | TGCCAGTTGCTGAAGAGGAAG | 1413 | AAGAGGAAGCCAGAAAAGCC | 2665 |
| 2FH21F_02_219 | AGCTCTCTGTTCAGCTGATC | 162 | CTCTCTACTGATGATCTGAA | 1414 | TACTGATGATCTGAACTCCCT | 2666 |
| 2FH21F_02_220 | CCTTTTTGACCACATTATCC | 163 | AAGAGGTTGCTGGGGCAAG | 1415 | GGCCAAGCCTCATATAA | 2667 |
| 2FH21F_02_223 | GTTGGAGTTGTGCATTGACAG | 164 | GAAGATGCTCTGAGGCAAA | 1416 | TCTGAGGCAAACTGCAA | 2668 |
| 2FH21F_02_226 | TGTTTTTGGAGTTGTGAGGC | 165 | GGTCCACTAAAAATCTTAG | 1417 | AAATCTCTAGTGTATCAGAAGTAA | 2669 |
| 2FH21F_02_227 | ACTCAGACAAACTCTTCCAG | 166 | TTCTTTGCAATGGAACAT | 1418 | TTTGGCAATGGAACATTATAAG | 2670 |

TABLE 4A-continued

| | | | | | |
|---|---|---|---|---|---|
| 2FH21F_02_228 | GGCAATGGAACATTATAAG | 167 | GAAAACCATACCTTACTCAG | 1419 | ATACCTTACTCAGACAACTCTTCGAG | 2671 |
| 2FH21F_02_230 | GTATAAATAATGTTCAGTTATC | 168 | ACTGGTCTTTACCTAGATG | 1420 | TACCTAGATGATTGCTTCTAAAT | 2672 |
| 2FH21F_02_232 | GTAAAATCTTGTAAGTTGCAG | 169 | TTATGCCACTTGAGTGGAG | 1421 | ACATTGTTGGTCCAATACTAAT | 2673 |
| 2FH21F_02_234 | AGGTGCAACTCCAAAAAAGC | 170 | AATCTTGAACCAGTGGTTCT | 1422 | ACCAGTGTTCTGGCTCC | 2674 |
| 2FH21F_02_235 | CTTGAACCAGTGGTTCTGGC | 171 | AGTGCACTCCAAAAAGC | 1423 | TGAGTTACAAAGATTATGACAAG | 2675 |
| 2FH21F_02_236 | GGAGTTGCACCTGTTCCTTG | 172 | GGAATGACAAATGCCAAATC | 1424 | TGACAAATGCCAAATCATGTCTTA | 2676 |
| 2FH21F_02_239 | TTGTGGAGGATTATTCTGC | 173 | TCCTTCTTATACAGTGGGC | 1425 | ATAACAGTGGGCTTTCACAAT | 2677 |
| 2FH21F_02_241 | AGAATCTCCTCACACCTTGC | 174 | GCAGGGACTCCCCAAGTGT | 1426 | ACTCCCCAAGTGTCCGACCCC | 2678 |
| 2FH21F_02_243 | AGGACTCTGCAACCCAGG | 175 | TGCTGGGCTGCCCTCCCTGT | 1427 | GGTGTGAGGAGATTCTT | 2679 |
| 2FH21F_02_248 | CTATAGAAATACTGGACT | 176 | GGAAGGAATCATTCTGAG | 1428 | AAGGAATCATTCTGAGTGAAAA | 2680 |
| 2FH21F_02_249 | CACTCAGAATGATTCCTTCC | 177 | TTAAAGGCTAGACAATGGG | 1429 | AGGGAGGAGACTCAGAA | 2681 |
| 2FH21F_02_250 | ACATGTCCAAATATGTCTG | 178 | TCCCTACCCCATTGTCTAGC | 1430 | TCTAGCCCCTTAAATACATTTGACAAT | 2682 |
| 2FH21F_02_254 | TATTTTTATTTCCAATGTAGT | 179 | CAATTAGAAATCTAGTGCAA | 1431 | AATTAGAAATCTAGTGCAAAAGAAT | 2683 |
| 2FH21F_03_005 | TCATCCGCATTTCTCAACTC | 180 | TATATAATACTTAGTTTTGGT | 1432 | ATAATACTTAGTTTTGGTCATCAA | 2684 |
| 2FH21F_03_007 | ATCAAAGCCATTAGCCTA | 181 | CTTCTTTTTGGATCTTCACCTG | 1433 | CTTCACCTGATAATTTTCACCATTTT | 2685 |
| 2FH21F_03_008 | TCAAAAGTGCTGGCCAGGTC | 182 | GATTAAAGTGCGAAAAGTG | 1434 | GTGCAGAAAAGTGAATCCA | 2686 |
| 2FH21F_03_011 | CTTTGTGTCTTTATCCCTG | 183 | GGTAATTTTTCCCTTGGG | 1435 | CTGGCCAGCACTTTTGA | 2687 |
| 2FH21F_03_012 | GACCTGGCCAGCACTTTGA | 184 | CCCAAGCTTAAAATGTGGGC | 1436 | ACCTTTGGTGTCTTTATCCCTG | 2688 |
| 2FH21F_03_013 | GACCTGGCCAGCACTTTTGA | 185 | CCCAAGCTTAAAATGTGGGC | 1437 | CAAGCTTAAAATGTGGGCCTAGAT | 2689 |
| 2FH21F_03_014 | GTTAAGGTGTTCTAAGGCTAC | 186 | GTGTCCAGAGAGGAAAAC | 1438 | AAAAACTTAGCTGAAAGGAACATGAAA | 2690 |
| 2FH21F_03_015 | TTCCTCTAAATTCCTTAGC | 187 | GAGAAAAGATATTCATGAGAC | 1439 | GAGACTATTAAGGAAATATAAAATGA | 2691 |
| 2FH21F_03_017 | TCAATATCTTACAGTACAG | 188 | GAGGTTCAATTTTATTCAT | 1440 | CATAAAAATGTAGTATATTCTTAGA | 2692 |
| 2FH21F_03_018 | GAGGTTCAATTTTATTCAT | 189 | TCAATATCTTACAGTACAG | 1441 | AAGAAATACTACACATTTTATGTTA | 2693 |
| 2FH21F_03_021 | TAGTTGCCCTGAGTTCAA | 190 | TAGAAAGAAACTCCTCCTCC | 1442 | CTCCTCCCCATAAAGGAAGA | 2694 |
| 2FH21F_03_022 | GCTGATCAAGGCAGTTTTTC | 191 | TTCCTTTATGGGAGGAGAG | 1443 | AGTTCTTTCTATGTCTTTGGTTAT | 2695 |
| 2FH21F_03_025 | CATGGTTCCTCCAGTCCTTC | 192 | ACTACCTGTTCCAGTCCTTC | 1444 | CTTCCAGAAGGAGCTGCCC | 2696 |
| 2FH21F_03_026 | GAGCTGATGGTGATCCAGAC | 193 | GGCACACTGCAACCACAGC | 1445 | AACCACAGCTGAACAC | 2697 |

TABLE 4A-continued

| | | | | | |
|---|---|---|---|---|---|
| 2FH21F_03_027 | ACTGCAACCACCAGCTGAAAC | 194 | GAGCTGATGGTGATCCAGAC | 1446 | ATGGTGTCTCCTCCATGCAG | 2698 |
| 2FH21F_03_028 | TGCAACCACCAGCTGAACAC | 195 | TTGGTGGAGCTGATGGTGAT | 1447 | GGTGATCCAGACCACTCT | 2699 |
| 2FH21F_03_030 | ATTCCTGGTCTTGGCAGATG | 196 | AGAACAGCCTCAGGCCACGA | 1448 | ACAGCCTCAGGCCACGACTTCTGTGCT | 2700 |
| 2FH21F_03_031 | TCAGGCCACGACTTCTGTGC | 197 | TGAATTCCTGGTCTTGGC | 1449 | CTGGTCTTGGCAGATGG | 2701 |
| 2FH21F_03_039 | AGCCCATGAAGGCTTCCAAA | 198 | CAAGTTGTCTCTGACCTAGC | 1450 | TCTGACCTAGCTCCCTT | 2702 |
| 2FH21F_03_040 | CTTGTTGCCTGGTTTTCATT | 199 | GAGCTAGGTCAGAGACAACT | 1451 | TCAGAGACAACTTGAACA | 2703 |
| 2FH21F_03_043 | TGTGAGCCTGGGCTCCCTG | 200 | TGTAGTCCCGGACCGTGTG | 1452 | GCCACATTCTCGATAAGTAGT | 2704 |
| 2FH21F_03_053 | GTAGGCAAGCTCATGCATTC | 201 | ACCAAGGTGTGGGAAGTT | 1453 | TGTGGGAAGTTCAGTGGC | 2705 |
| 2FH21F_03_058 | CTATGTGGAATACAAAATGCC | 202 | CCTACTGATTTATAATTCC | 1454 | AATTCCTTTATTTTCACATATACTAAA | 2706 |
| 2FH21F_03_061 | TAAAGATGATTTCCCAAGT | 203 | AAGGAGCTTACTAACTGTGG | 1455 | ACTGTGGTTTGCACCCTAA | 2707 |
| 2FH21F_03_062 | TATCAAGTACTTTGTCCAT | 204 | CTCTGCAGTACTGTATCCAC | 1456 | CCAACTGCTGTATTTAACA | 2708 |
| 2FH21F_03_063 | GCCTCATTCTCTGCATTCAC | 205 | TCGTGTGGATACAGTACTGC | 1457 | CAGTACTGCAGAGAAAGA | 2709 |
| 2FH21F_03_064 | TCGTGTGGATACAGTACTGC | 206 | GCCTCATTCTCTGCATTCAC | 1458 | ACCATGTCTGCTCAAATCTTCACAGAG | 2710 |
| 2FH21F_03_065 | CATGGTCAGTGAATGCAGAG | 207 | CTCTTTCTGGATACAGAGAC | 1459 | AGTTTGGAGATTACAGGT | 2711 |
| 2FH21F_03_071 | TGCTTTTAAAGACATCAGG | 208 | AGAAGTGTATTTTGGTTT | 1460 | AGTGGTATTTCTGTTTTAATC | 2712 |
| 2FH21F_03_073 | CTTCTGATGAAACCAAATC | 209 | CTTTCAGTCCAAAATAGTTAG | 1461 | CCAAAATAGTTAGACCCTTG | 2713 |
| 2FH21F_03_079 | AAATTAATGGATTTGACATC | 210 | CTGAAAAGCTAATGGGATGC | 1462 | TGGGATGCCTTTTACTT | 2714 |
| 2FH21F_03_080 | AACTGAGATAGTGGGAAAC | 211 | GAGAAGAAAGCATCATAG | 1463 | AGAAAAGCATCATAGTTCTGAAATG | 2715 |
| 2FH21F_03_081 | GAAAAGCATCATAGTTCTG | 212 | TATCAACTGAGATAGGTGGG | 1464 | CCTCTCATTTGTGCTTAG | 2716 |
| 2FH21F_03_083 | CTATTCCATTTGACATAGTAG | 213 | AGTTTCCACCTATCTCAG | 1465 | TGTCCAAAAACATCCTTC | 2717 |
| 2FH21F_03_084 | CTATTCCATTTGACATAGTAG | 214 | AGGTTTCCCACCTATCTCAG | 1466 | CATGCATCAGAGTAGAAAGA | 2718 |
| 2FH21F_03_085 | CCCACCTATCCAGTTGATA | 215 | GTTATCTATTCCATTTGACA | 1467 | GTTATCTATTCCATTTGACATAGTAG | 2719 |
| 2FH21F_03_087 | GGACTTGATTCAAATGTT | 216 | CACCAATTAGGGCTAATAAA | 1468 | GTGGGGTACTGTAACATAT | 2720 |
| 2FH21F_03_088 | GTCCAAATATAAGAAACTGTC | 217 | GGTTAGAAAATAAGTGTACTA | 1469 | AAGTGTACTATTTGTGTGATAAA | 2721 |
| 2FH21F_03_089 | AGTTTACTGCTTCCATGTGC | 218 | ACATGACAGTTTCTTATATT | 1470 | ACATGACAGTTTCTTATATTTGGACT | 2722 |
| 2FH21F_03_091 | GACAGTTTCTTATATTTGGAC | 219 | TTAGTTTACTGCTTCCATG | 1471 | TGCTTCCATGTGCAATC | 2723 |

TABLE 4A-continued

| | | | | |
|---|---|---|---|---|
| 2FH21F_03_093 | TCTTTTAGCCCTGTACACTC | 220 | CTTCCATAATCTTACTCTGTG | 1472 | TTACTCTGTGAAATAGAGGAAT | 2724 |
| 2FH21F_03_094 | CTTCTGTCCAAGATCTCCTG | 221 | CCTCTATTTCACAGAGTAAG | 1473 | TCACAGAGTAAGATTATGGAAG | 2725 |
| 2FH21F_03_095 | TATATAGCATTTTGTTAGTG | 222 | GATTTGAGTGCATGTTTTA | 1474 | TGAGTGCATGTTTTAAACCTCTA | 2726 |
| 2FH21F_03_097 | AGGTCAGCAGCCTCCAGAG | 223 | ACAGCCATGTTCCCACCAGG | 1475 | CACCAGGGTCAAGAGAA | 2727 |
| 2FH21F_03_098 | TCCCACCAGGGTCAAGAGAA | 224 | CAGGTCTCCAGGTCAGCAG | 1476 | CTCCAGGTCAGCAGCCTCCAGAGGGG | 2728 |
| 2FH21F_03_100 | TGCTGACCTGGAGACCTGC | 225 | ATATAGCTAGCAAGGCTGGG | 1477 | AAGGAGAGCTGGCAAGA | 2729 |
| 2FH21F_03_101 | ATATAGCTAGCAAGGCTGG | 226 | TGCTGACCTGGAGACCTGC | 1478 | CTCCTTCCTCTTTCTCCAGA | 2730 |
| 2FH21F_04_006 | TCTAGAATTCTATCAGAAG | 227 | TCTCAGAGTATGACTGAGC | 1479 | ACTGAGCAGTTGCTCAAG | 2731 |
| 2FH21F_04_008 | GATTCTGTTGTTAGCATTAT | 228 | TATGATTTGAAATCATTCAG | 1480 | ATTTGAAATCATTCAGGACTTT | 2732 |
| 2FH21F_04_010 | TATAACACATCCCCACATGC | 229 | TTAGTCTTTCTTGCTGGGA | 1481 | TTAGTCTTTCTTGCTGGGAATCAAA | 2733 |
| 2FH21F_04_011 | AGTCTTTCTTGCTGGGAATC | 230 | TATAACACATCCCCACATGC | 1482 | TCCCCACATGCATCCTT | 2734 |
| 2FH21F_04_014 | TGATCACTTGGAGAGATTTG | 231 | ACAGGTCATTGAAACAGACA | 1483 | GGTCATTGAAACAGACATTTTAA | 2735 |
| 2FH21F_04_015 | AAGAAATTCTGACAAGTTTA | 232 | AATGTCTGTTTCAATGACC | 1484 | CTGTTTCAATGACCTGTATT | 2736 |
| 2FH21F_04_017 | AAGAGCCATCCAGAGAGAC | 233 | GGACACAGTGCAGGTTCAG | 1485 | TGCAGGTTCAGGGCAAGGTGTG | 2737 |
| 2FH21F_04_018 | GTAAGAATTGGGGTTAGGTC | 234 | TCTCTCTGGATGGCTTCTTG | 1486 | GGTGACTGACAGAGGGA | 2738 |
| 2FH21F_04_019 | TCTCTCTGGATGGCTTCTTG | 235 | TGGAGTAAGAATTGGGGT | 1487 | AAGAATTGGGGTTAGGTC | 2739 |
| 2FH21F_04_021 | CTAACCCCAATTCTTACTCC | 236 | GTACTTGAGAGAAACTAGGG | 1488 | GACACAGTCTCCAGCAGAAT | 2740 |
| 2FH21F_04_022 | AAGCCCAGTGAAATCACAGC | 237 | TCTGCTGGAGACTGTGTCTT | 1489 | GGAGAGACTGTGTCTTAAAACTT | 2741 |
| 2FH21F_04_023 | GAAGGAGTAGGTGGTGGGAT | 238 | CTGAAGCTCAAGCAAGCAAG | 1490 | CAAGCAAGGCAGAGAAA | 2742 |
| 2FH21F_04_024 | CTGAAGCTCAAGCAAGCAAG | 239 | CGAAGGAGTAGGTGGTG | 1491 | GAGTAGGTGGTGGGATCTC | 2743 |
| 2FH21F_05_003 | GAAGTGGCCTATCAGTCT | 240 | AACCATGGTTTGGGTTTAC | 1492 | CACTGTTCTATTACAGTGTTCTTC | 2744 |
| 2FH21F_05_005 | GGTGGTAATTGAGATGACTG | 241 | TTGTAAACCCAAACCATG | 1493 | CCCAAAACCATGTTCTT | 2745 |
| 2FH21F_05_006 | GTTTTCCCATATCTAGATGTC | 242 | GTGAATTCTTCCCACTTCTC | 1494 | CACTTCTCACTTATCATCTG | 2746 |
| 2FH21F_05_007 | GTGAATTCTTCCCACTTCTC | 243 | TCTTATGTTTTCCCATATC | 1495 | CTTATGTTTTCCCATATCTAGATGTC | 2747 |
| 2FH21F_05_008 | TTCCAAGGATTGGAGGACAC | 244 | GACATCTAGATATGGGAAAAC | 1496 | AGATATGGGAAAACATAAGAAAA | 2748 |
| 2FH21F_05_013 | GTGCAACAAATGCCTTTAA | 245 | TTAACATGTTTTCTCTCAC | 1497 | TTAACATGTTTCTCTCACTGTACT | 2749 |
| 2FH21F_05_015 | AAACAAGCACTGTAGAGTA | 246 | CTTTCTTACAACCTATGACTC | 1498 | AACTATTGGCAATTCTGTAATTC | 2750 |

TABLE 4A-continued

| | | | | | |
|---|---|---|---|---|---|
| 2FH21F_05_016 | ATTTAATAGAACAAACCCC | 247 | CTATTGGCAATTCTGTAATTC | 1499 | TACTCTACAGTGCTTGTTTA | 2751 |
| 2FH21F_05_018 | ACTTTTGAATGCCGCAAT | 248 | CTTCACTACTTGTACTGCTG | 1500 | CCCTTTTAGGGTCTACTC | 2752 |
| 2FH21F_05_019 | GAGTAGACCCTAAAAGGGAC | 249 | TATTCAGTTCTTCATTCTC | 1501 | ATTCAGTTCTTCATTCTTCATC | 2753 |
| 2FH21F_05_025 | TATTGTAATGTGAATTTGC | 250 | GGACACTAAACAAAGACAGG | 1502 | AAACAAAGACAGGTTCAAAATAC | 2754 |
| 2FH21F_05_026 | TATTGTAATGTGAATTTGC | 251 | GGACACTAAACAAAGACAGG | 1503 | GGATGTTTCTGAACAAT | 2755 |
| 2FH21F_05_027 | TTTAGCATTCCCAGACTCAG | 252 | ATTGGCCAACATCTCAACAG | 1504 | ACATCTCAACAGAGTTACA | 2756 |
| 2FH21F_05_028 | TGGCCAACATCTCAACAGAG | 253 | TTTCATTTAGCATTCCCAG | 1505 | GCATTCCCAGACTCAGA | 2757 |
| 2FH21F_05_032 | GAATTAGACTATCCCAGTGC | 254 | TTCCCAGCCATACTCTGGAC | 1506 | TCTGGACTTTATTTGCTAACCATAA | 2758 |
| 2FH21F_05_033 | GGACTTTGGCACCCAAGGA | 255 | AATAAAGTCCAGAGTATGC | 1507 | GAGTATGCTGGGAATT | 2759 |
| 2FH21F_05_034 | CTTCCCCCTGGGCTTTCCT | 256 | TGATGGTGGTTGTGAAAGTG | 1508 | ATGGTGGTTGTGAAAGTGATTTAG | 2760 |
| 2FH21F_05_035 | GTAAACAATAAACCTCCATTC | 257 | CTTTCACAACCACCATCAAG | 1509 | CACCATCAAGCTTACAACATC | 2761 |
| 2FH21F_05_040 | CCAATAAACAGCCTCCTATA | 258 | CTCAATGCAAAGGACAAATC | 1510 | CCTTCCCTTTAGTAGTAGAG | 2762 |
| 2FH21F_05_041 | CCTTCCCTTTAGTAGTAGAG | 259 | AGGACCAATAAACAGCCTCC | 1511 | ACCAATAAACAGCCTCCTATAAA | 2763 |
| 2FH21F_05_044 | CACAGCCCAAATGTGTAAATG | 260 | GATGCCAAGTCCTTTCC | 1512 | ATGCCAACGTCCTTTCCATGCAC | 2764 |
| 2FH21F_05_045 | GATGCCAAGTCCTTTCCAT | 261 | CACAGCCCAAATGTAAATG | 1513 | AAATGTAAATGGCACTGT | 2765 |
| 2FH21F_05_047 | CCATTTACACATTTGGGCTG | 262 | CCACCCCAGTCATCTCTG | 1514 | CCAGTCATCTCTGGTGTCA | 2766 |
| 2FH21F_05_051 | GATGCATGAATTCCAGAGCC | 263 | CAAAAATCATTATTCTGTGC | 1515 | TGGCCCTGGGAAGGGAAATAA | 2767 |
| 2FH21F_05_054 | TATATTATACAATAGAGAGG | 264 | ACTCAGGAGTACTTATGAGA | 1516 | TGAGAAAAGAATAAGAACAAAAA | 2768 |
| 2FH21F_05_058 | AGGTAATCCACATCAACC | 265 | CTTGAGACACTAATACAGAG | 1517 | ACTAATACAGAGTGTGTTCGC | 2769 |
| 2FH21F_05_061 | ACTGTTATGTACATTATATC | 266 | GTGTGCTTGCCTCCCTAATTT | 1518 | CCTCCTAATTTAAAATACTGTATTC | 2770 |
| 2FH21F_05_064 | TTTTGGGTGCCAAACACCTA | 267 | TGACTTGGACGGTCAAAAGG | 1519 | TTTGACGGTCAAAAGGAGAATG | 2771 |
| 2FH21F_05_066 | GGACGGTCAAAAGGAGAATG | 268 | GTGAAATTTGGGTGCCAAAC | 1520 | GGGTGCCAAACACCTAC | 2772 |
| 2FH21F_05_067 | TGGCACCCAAATTTCACTG | 269 | GGCCTCTCAATTTATATTGC | 1521 | TATTGCTTTGCACTTTGGTTTGATA | 2773 |
| 2FH21F_05_069 | ATCAAACCAAAGTGCAAAGC | 270 | GAAAAGGAACATAGAATCTG | 1522 | GAATCTGTTTTACAGAGTAAAT | 2774 |
| 2FH21F_05_072 | TTTGAGAAGGAGACCTTAGC | 271 | ACATTTGAAACATTAGATTTT | 1523 | CATTTGAAACATTAGATTTTTCACT | 2775 |
| 2FH21F_05_073 | GAAGCTAAGGTTCTCCTTCTC | 272 | GCAAAGCAGCCTAACTCTTC | 1524 | TTTCTCACCTCTGATTCC | 2776 |

TABLE 4A-continued

| | | | | |
|---|---|---|---|---|
| 2FH21F_05_074 | GATGCAAAGCAGCCTAACTC | 273 | GAAGCTAAGGTCTCCTCTC | 1525 | GAATCAGAGGTGAGAAATGTCGG | 2777 |
| 2FH21F_05_076 | GTGCAGACTGTTATCTAGAG | 274 | TAAATGTGCCTCCCAGTGCC | 1526 | TGCCTCCCAGTGCCCAGAATGAGACCC | 2778 |
| 2FH21F_05_080 | ACACGGTGAAGTTCTTAAC | 275 | TCCTTGGAACAGTTCACCAT | 1527 | AGTCACCATCAGTCCA | 2779 |
| 2FH21F_05_083 | GAATGCTTTGGAAGAAGCTG | 276 | GAAAGTCCTTTCCATAGGGG | 1528 | TCCATAGGGATCAGTG | 2780 |
| 2FH21F_05_088 | GTGGAACATCTTATTCACG | 277 | TGCAACATGGGCTTCAGTA | 1529 | GGCTTCAGGTAAGAGTT | 2781 |
| 2FH21F_05_091 | AGAATTATTGCCATGTAC | 278 | CCTTGCTGAAAGTTAAATC | 1530 | TCTCCTTGCTCAGAACTCT | 2782 |
| 2FH21F_05_092 | CAAGGAGATTAACCTTTC | 279 | TTGTCGCCCACTGTTCCTGT | 1531 | TTCTTGGTAACCAAAATCACATC | 2783 |
| 2FH21F_05_094 | CTGAGCAAGGAGATTAAACC | 280 | TTGTCGCCCACTGTTCCTG | 1532 | TCGCCCACTGTTCCTGTCCACC | 2784 |
| 2FH21F_05_096 | TGATGATCTGGCCCTTGTTG | 281 | AGGTGATTGGATGTACGAC | 1533 | ACGACTACACCGCAGAATGA | 2785 |
| 2FH21F_05_097 | TGACTTCTCCTTTCCACCAG | 282 | ATGAGCTGGCCTTCAACAAG | 1534 | AAGGGCCAGATCATCAAC | 2786 |
| 2FH21F_05_098 | ATGAGCTGGCCTTCAACAAG | 283 | CCCACTTGTCCATTGACTTC | 1535 | TCTCCTTTCCACCAGTC | 2787 |
| 2FH21F_05_099 | TCATATGTTGTCCATCCCC | 284 | TGGGCAGTGATATGGGATAG | 1536 | GGGTCTCTTTGAGGACTT | 2788 |
| 2FH21F_05_101 | TTTGCTCCTATCTCTGCAAG | 285 | AGAAGAACTCACTGCAGAGC | 1537 | TACCTTAGTTGCATGTGAT | 2789 |
| 2FH21F_05_102 | GGGAAAGTCAATTGAGTAAC | 286 | TTACTTGCAGAGATAGGAGC | 1538 | AGAGATAGGAGCAAAATTACAAAAA | 2790 |
| 2FH21F_05_109 | CTCTTCTTAATGGGAAGCAG | 287 | TCCCAAACTTGGGCAAAG | 1539 | CTTGGGCAAAGTTGACA | 2791 |
| 2FH21F_05_110 | CCAAAACTTGGGCAAAGTTGA | 288 | TCCTCTTCTTAATGGGAAGC | 1540 | ATGGGAAGCAGCTCCTTA | 2792 |
| 2FH21F_06_001 | CATGTTAGCACCTCACTA | 289 | TACCTTTTTCTCAACATGA | 1541 | CTCAACATGACACCAACACA | 2793 |
| 2FH21F_06_004 | GGAATTGGATCAAATGATT | 290 | TTGGCAGTATGTATAATGGC | 1542 | TAATGGCATTTGCTGTGTT | 2794 |
| 2FH21F_06_005 | GGAAAAAATGTTAATATGGC | 291 | CAATACTGAACTGTACAAGAG | 1543 | AAGAGTTATTATTTTCCTTAATCTC | 2795 |
| 2FH21F_06_006 | CATCCAAAGTTTTGTCATCA | 292 | TTTAGTAATACAAAAAAGCC | 1544 | AAAAAAGCCATATTAACATTTTTTCC | 2796 |
| 2FH21F_06_007 | CATGATGTACAAAACTTTGG | 293 | GGTGGATTTTCCTCCAAGTG | 1545 | GGTGGATTTTCCTCCAAGTGATTAAA | 2797 |
| 2FH21F_06_011 | GTTAAGATAGGAAAGACCC | 294 | TTTTAGTTAGGGTTTCTTG | 1546 | TAGTTAGGGTTTCTTGATCTTGG | 2798 |
| 2FH21F_06_012 | GGAATAATGGATCAAAAATAG | 295 | CCCTTCTAAGTGTTATTTG | 1547 | CAAGGGTGTTTGGTAAGGTC | 2799 |
| 2FH21F_06_013 | TTAGTAGCAAGGGTGTTTGG | 296 | TTAATTGGAATAATGGATCA | 1548 | ATTGGAATAATGGATCAAAAATAG | 2800 |
| 2FH21F_06_015 | GACATCATCCATTCAACACC | 297 | GCTTAGTGCTTGGCTAATTTC | 1549 | TTGGCTAATTTCCAAATTATTGC | 2801 |
| 2FH21F_06_018 | TCTATAGACTCTCACTCAG | 298 | GAGAAAAATTTCATAAAGCC | 1550 | GAGAAAATTTCATAAGCCATTCTC | 2802 |
| 2FH21F_06_023 | TGGTAACAGATTTGACATGG | 299 | TCTGAAGTTTTCAAGCTCTG | 1551 | TCAAGCTCTGAAATTCATAATC | 2803 |

TABLE 4A-continued

| | | | | | |
|---|---|---|---|---|---|
| 2FH21F_06_025 | TCAGAGCTTGAAAACTTCAG | 300 | TGAGACTTCTAGTCTTAGG | 1552 | GGTTAATTTTTAGGAAGATCTTG | 2804 |
| 2FH21F_06_026 | TTCTGTGAGCACACTAAAA | 301 | TAAGACCTAGAAGTCTCAG | 1553 | AGTCTCAGTATTATTAGAACATAAA | 2805 |
| 2FH21F_06_028 | GTGTGCTCACAGAAAATTAG | 302 | GAGATGGAATGTAACTTTGC | 1554 | CTTACAAAAATTGCTATTAAACTCCT | 2806 |
| 2FH21F_06_029 | TCAGATGCAATGGTTTTGTG | 303 | GCAAAGTTACATTCCATCTC | 1555 | TTCCATCTCTAAGTCAAATTGGTC | 2807 |
| 2FH21F_06_031 | CCACAGTATAAACAGTAAC | 304 | CTGCAGTCATCTTGGACCTT | 1556 | AAACTCAACCAAGCTGTGATAAG | 2808 |
| 2FH21F_06_034 | TGTACCAGTCAGTGATTAAG | 305 | ATTAAGTCATAAACCAC | 1557 | GTCATAAACCAGCAATAAACATA | 2809 |
| 2FH21F_06_035 | GTTCTACTTAATCACTGAC | 306 | GATCATAGTCTTAGGAGTTC | 1558 | GAACTTTTCACTTATCTCATGTTAG | 2810 |
| 2FH21F_06_037 | GAACTCCTAAGACTATGAT | 307 | ACAACACTACAAGTCTTGA | 1559 | GAAAAAACACCAATACCCA | 2811 |
| 2FH21F_06_038 | GAAATGTGTAAAGGCTGTC | 308 | GTGTTGTAAACCTGCCTCAC | 1560 | AAATACATGGTAATAACTTTCTT | 2812 |
| 2FH21F_06_045 | ACTCAGACGTGGTGGAAAAC | 309 | TGAGAGCTCCAACTCCAAAC | 1561 | TCCAAACCAGAAACTATTAG | 2813 |
| 2FH21F_06_046 | TGAGAGCTCCAACTCCAAAC | 310 | ACTCAGACGTGGTGGAAAAC | 1562 | GTGGTGGAAAACAATTTAC | 2814 |
| 2FH21F_06_047 | AACGTGGCATTGTCCCCAAG | 311 | GTCAGCTAATGCCACATGGT | 1563 | TAATGCCACATGGTAATGCTGC | 2815 |
| 2FH21F_06_051 | CCAGGTCTTGATAGTCTTTG | 312 | AGATGAGTGAGCAGGAAGAG | 1564 | AGAGGAGCTTGAGGATG | 2816 |
| 2FH21F_06_052 | ACTGCTTTTTCCAGGTCTT | 313 | TGATGAGATGAGTGAGCAGG | 1565 | AGAGGAGCTTGAGGATGA | 2817 |
| 2FH21F_06_053 | TGTATCTCCACTTTGACC | 314 | AGAAACAAAGTGAAAGATGC | 1566 | AGGCTGAATGGGGAAAA | 2818 |
| 2FH21F_06_060 | GGTAGAGTTGCAAATAATT | 315 | CCACCCACATTTTCTCAGC | 1567 | ATACCTCCATCTGCACC | 2819 |
| 2FH21F_06_061 | CCACCCACATTTTCTCAGC | 316 | GTTGCAAATAATTGGTGAG | 1568 | GCAGATGAGGTATCTTA | 2820 |
| 2FH21F_06_062 | GTGCAGATGGAGGTATCTCT | 317 | TTCTCCCACCCACATTTTTC | 1569 | CTCCACCCACATTTTCTCAGCAATT | 2821 |
| 2FH21F_06_064 | GGGAAAGGACATCCCTTC | 318 | TGTAGTGATGGGAGGGATTC | 1570 | GATTCAAATCCTCCTCTTCAGCAAAG | 2822 |
| 2FH21F_06_065 | CCTGTTTTGAGTAAACAGT | 319 | GTCTCATGGGCTGCAAAC | 1571 | GGGCTGCAAACCACCAA | 2823 |
| 2FH21F_06_068 | ACTGTTTACTCAAAACAGG | 320 | GATACTTACTGAATTATTG | 1572 | GATACCTACTGAATTATTGAGGATA | 2824 |
| 2FH21F_06_073 | AATCACTGGGAAACAAAGAC | 321 | GAAAATGCCAACTTTCTGGG | 1573 | TTACCATTTGTGGTTTATTTGCTCT | 2825 |
| 2FH21F_06_075 | TTCATTTGTCCCTGGTACAC | 322 | GACTGGAAACTGTTGAAAG | 1574 | ACTGGAAACTGTTGAAAGTTAAAAA | 2826 |
| 2FH21F_06_076 | GACTGGAAACTGTTGAAAG | 323 | GGATACTTTCATTTGTCCCTG | 1575 | TTGTCCCTGGTACACAT | 2827 |
| 2FH21F_06_077 | AGAAAGGCTTGACAATAAT | 324 | ATGTGTACCAGGGACAAATG | 1576 | ATGAAAGTATCCTTCCAAAATA | 2828 |
| 2FH21F_06_079 | TGGATTTGCTGTTGATCACC | 325 | CCCAAATTATTGTCAAGC | 1577 | AATTATTGTCAAGCCTTTCT | 2829 |

TABLE 4A-continued

| | | | | |
|---|---|---|---|---|
| 2FH21F_06_082 | TCAGAGACACTGCATATTCTGG | 326 | AATCTCCAGTAAACTCTAGG | 1578 | GTAAACTCTAGGATATATCCAAAGGTGT | 2830 |
| 2FH21F_06_083 | GTTTTGCTGACATTAGTTG | 327 | CAGAATATGCAGTGTCTGAG | 1579 | GAATATGCAGTGTCTGACTCCGAGAAACTT | 2831 |
| 2FH21F_06_084 | GCTAGAGAAAAGCCAGG | 328 | TCAGGGTACAAGCAGCTGTC | 1580 | CAGCTGTCTGACTCCAAACCCTTTAT | 2832 |
| 2FH21F_06_088 | GAAAATATGTGCTTTTATCTG | 329 | TTATCTATAGAAACACTCC | 1581 | AGAAACACTCCCAAAGC | 2833 |
| 2FH21F_06_092 | CCTTGATAGTATTGCCACTC | 330 | CATCATTCCCTATTGACTG | 1582 | TGACTGATTTTAACCTATCAT | 2834 |
| 2FH21F_06_093 | TCCTGAAGTTCAGAAACAG | 331 | TTTCTTAACCAGAGAGCTTC | 1583 | TAACCAGAGAGCTTCCTGGCCCACA | 2835 |
| 2FH21F_06_095 | AGACCCTTATTCCAAGGGTA | 332 | TTCCCAGGGCCCAAAGCAAG | 1584 | TTCCCAGGGCCCAAAGCAAGAGAAATG | 2836 |
| 2FH21F_06_099 | GACTTGAGCAACACACAAATG | 333 | CTAAGTAAATCAGGCTTTGG | 1585 | AGGCTTTGGACAGGCTC | 2837 |
| 2FH21F_06_102 | CCTTTCTGACAGAAAGGTA | 334 | GATGGAATTTCTCTTTGCACC | 1586 | AATTTCTCTTTGCACCTGAACAA | 2838 |
| 2FH21F_06_107 | CTTAGATTCACACTCCAAGCC | 335 | TCTGTGCTAGGAGAAGGAG | 1587 | AGGAGAAGGAGAATTTGGG | 2839 |
| 2FH21F_06_110 | GACTCATCAACTTCTCAT | 336 | GGAAAACTCAAACATGGACTG | 1588 | AACATGGACTGGAGTGG | 2840 |
| 2FH21F_06_111 | GTCTGTTGATTTCAAAACAC | 337 | CACTCCAGTCCATGTTTGAG | 1589 | GAGTTTTCCAAATCCACAT | 2841 |
| 2FH21F_06_112 | CACTCCCAGTCCATGTTTGAG | 338 | GGATTAAGTATATGTCTGTTG | 1590 | TCTGTTGATTTCAAAACACA | 2842 |
| 2FH21F_06_113 | GAGAATTAAAATGAACTGAGG | 339 | GTGTTTTGAAATCAACAGAC | 1591 | CATATACTTAATCCTTTTGCCTCA | 2843 |
| 2FH21F_06_114 | TACTTAAATCCTTTTGCCTC | 340 | GAGAATTAAAATGAACTGAG | 1592 | GAGAATTAAAATGAACTGAGGATTTC | 2844 |
| 2FH21F_06_117 | CTGCATATATCTTCTGCCTC | 341 | CTGGTTTTGAATTACATTGGC | 1593 | ATTACATTGGCTAACTTCAGAAAA | 2845 |
| 2FH21F_06_118 | CTGGTTTTGAATTACATTGGC | 342 | ACTGCATATATCTTCTGCC | 1594 | CTTCTGCCTCAATTACTTTC | 2846 |
| 2FH21F_06_119 | AAGCCTATTATTATCATACAG | 343 | AGAATGACAACTGACATTT | 1595 | GAGGCTTATAAAATGATTAAAGG | 2847 |
| 2FH21F_06_127 | GGGCTGCGAGTTCAAATTC | 344 | CTGCCCTTTTCAATTCTG | 1596 | CCCTTTTCAATTCTGTCTGAG | 2848 |
| 2FH21F_06_128 | GAATTTGAACTCGCAGCCCCC | 345 | CTGTGAAACCATGGGAAGTT | 1597 | AAGTATACAATCAGGCAGAAAAA | 2849 |
| 2FH21F_06_129 | GAATTTGAACTCGCAGCCCC | 346 | CTGTGAAACCATGGGAAGTT | 1598 | TGACTTTTACAGGCACTT | 2850 |
| 2FH21F_06_130 | AGAGGATTCAGCCTGCTCA | 347 | ATAACTTCCCATGGTTTCAC | 1599 | CCCATGGTTTCACAGCAAAG | 2851 |
| 2FH21F_06_132 | GCACAGGCTTTTAAACCA | 348 | GAGACATTGTCCTTTTGAAG | 1600 | TTTGAAGATGTGGAAAGTAAT | 2852 |
| 2FH21F_06_133 | GCAATTTGACACACCTTAAAGC | 349 | TTGTCCTTTTGAAGATGTGG | 1601 | AGCAGGCTGAATCCTCT | 2853 |
| 2FH21F_06_134 | AGTGAGCAGGCTGAATCCTC | 350 | GCAGCAGGGTATAACAAAGC | 1602 | TGACACCTTAAAGCAGAA | 2854 |
| 2FH21F_06_135 | TGGGTTTAAAAGCCTGTGC | 351 | TATCTGTGTAGCAGCAGGG | 1603 | GCAGGGTATAACAAAGCTAAA | 2855 |
| 2FH21F_06_137 | TATATATGTTAGCACAGAC | 352 | CTGTTTGACTATTCTGATCTC | 1604 | TGATCTCTTAAGATGCATCTGAAAAA | 2856 |

TABLE 4A-continued

| | | | | |
|---|---|---|---|---|
| 2FH21F_06_138 | ACTAGCTGTAACCTTTGTGC | 353 | CTTAAGAGATCAGAATAGTC | 1605 | ATCAGAATAGTCAAACAGTAG | 2857 |
| 2FH21F_06_140 | ACGAGGTCAAATCTGCTCC | 354 | CCATCTTCAAGTTTTAAGCAC | 1606 | GCACAAAGGTTACAGCTAGT | 2858 |
| 2FH21F_06_141 | GCACAAAGGTTACAGCTAGT | 355 | ACGAGGTCAAATCTGCTCC | 1607 | TCCAACAGTGGAAATAAAAT | 2859 |
| 2FH21F_06_142 | CTTCATTCAGAATCTTTTTC | 356 | CAGATTTGACCTCGTCTCTC | 1608 | GCAGAAAACTTCAACAAAGG | 2860 |
| 2FH21F_06_144 | CACTGGGAAAAGTGCACCT | 357 | ATGCAGTGCTTAGGAAGTGG | 1609 | GTGCTTAGGAAGTGGATAAAAGTCAA | 2861 |
| 2FH21F_06_147 | TGTTTTGGAATGGGAGGGAG | 358 | TGCCACTGCACCAGGAGAAA | 1610 | AGGAGAAAGGAGTCACTAG | 2862 |
| 2FH21F_06_148 | TGCCACTGCACCAGGAGAAA | 359 | TCTTTTGGAATGGGAGGGAG | 1611 | TTTTCTCTTCCCCATCC | 2863 |
| 2FH21F_06_149 | GATGACATTCTTCCTGTCT | 360 | TCCCTCCCATTCCAAAAGAG | 1612 | GAAGAAAAAACCTGGACAGCCAGATA | 2864 |
| 2FH21F_06_150 | GCCTGAGTCTCTCTAATT | 361 | TGCTTCAGCTAGTGCTTAC | 1613 | AGGTGCTTACAGGTGAA | 2865 |
| 2FH21F_06_153 | CATGTAGCAAATTTGGTTTC | 362 | GGAGAAGAGCATAGCTAGAC | 1614 | GCCTGAGTCTCTCTAATT | 2866 |
| 2FH21F_06_155 | CATGTAGCAAATTTGGTTTC | 363 | GAGGCTGGAGAAGAGCATAG | 1615 | AGAAGAGCATAGCTAGAC | 2867 |
| 2FH21F_06_156 | CCATTCAAACAAAAGCCCG | 364 | GTCTAGCTATGCTCTTCTCC | 1616 | CTAGCTATGCTCTTCTCCAGCCTC | 2868 |
| 2FH21F_06_159 | AGAACCGAGGGATGCAAAAC | 365 | TCTTTGAAACATGCATGACTC | 1617 | AAACAGCATGACTCAGATAG | 2869 |
| 2FH21F_06_163 | GGAACCAAGACTACACTGAG | 366 | TGGTGTTTATGGATGAGTGG | 1618 | GAGGTTGAAGGAGAGGC | 2870 |
| 2FH21F_06_165 | GGGCTGTTTCAATGAGGGAC | 367 | GGTACCACTCATCCATAAAC | 1619 | CTCATCCATAAACACCAACACT | 2871 |
| 2FH21F_06_166 | GATGTCTGTGTCTAAAATTGG | 368 | TGTGTATCATAAAGTCCCTC | 1620 | CCCTCATTGAAACAGCCC | 2872 |
| 2FH21F_06_168 | GTCCCTCATTGAAACAGCCC | 369 | GGGAGGATGTCTGTGTCTAA | 1621 | GGAGGATGTCTGTGTCTAAAATTGGT | 2873 |
| 2FH21F_06_172 | ATTGTGCAATTAAATGACC | 370 | CTCTCTTCTGGAAATCATCG | 1622 | GGAAATCATCGATGAAAAAGCATGTT | 2874 |
| 2FH21F_06_176 | AGACCTTGTTGTCTAGGGTG | 371 | AACAGCCAAAAGCCTATC | 1623 | CCAAAAGCCTATCATCACA | 2875 |
| 2FH21F_06_179 | CCTCATCATTTTCAGCCTGG | 372 | TATGGGAGAGGGTAAAAAG | 1624 | GGGAGAGGGTAAAAAGAGGTTAA | 2876 |
| 2FH21F_06_182 | GCTCAGGTATTTTATAAGGC | 373 | AGTTAGTTACCAACTCCTAG | 1625 | CCAACTCCTAGAAGCCA | 2877 |
| 2FH21F_06_183 | GCTCAGGTATTTTATAAGGC | 374 | GTTACCAACTCCTAGAAGCC | 1626 | GATGTGTAAAATAACTGAGAAA | 2878 |
| 2FH21F_06_194 | CAGAACCGCCTAGAAGGCAA | 375 | TTCCGCAGCCCCACAGCTAAG | 1627 | CAGCTAAGTCACTCTGA | 2879 |
| 2FH21F_06_196 | TCACTGAAACCGCGGAAG | 376 | GGCAGCGAAGGGGCCTCAC | 1628 | GCAGCGAAGGGGCCTCACGGGG | 2880 |
| 2FH21F_06_198 | GCGAAATGACCTGTTTACC | 377 | TGTAAACACCAACGCAGGAAC | 1629 | CGCAGGAACATCATGAAAA | 2881 |
| 2FH21F_06_204 | AGCTGTCCAGATAATTTGGG | 378 | GAAGCCACAGGCTCACAG | 1630 | GGATAAGAACCAGGAAAACAT | 2882 |

TABLE 4A-continued

| | | | | |
|---|---|---|---|---|
| 2FH21F_06_213 | ACCCTCAGTACCACTATCTC | 379 | GAAAGTTCTTGTATTAAAAG | 1631 | GAAAGTTCTTGTATTAAAGAAGTGG | 2883 |
| 2FH21F_06_219 | CTTGTATTAAAGAAGTGG | 380 | ACCCTCAGTACCACTATCTC | 1632 | TCAGTACCACTATCTCAATCTT | 2884 |
| 2FH21F_06_224 | GGAGTCAAGGGAGCATTTTA | 381 | CAAGGATTCCAGTACTGAG | 1633 | CAGTACTGGAGAATGTCT | 2885 |
| 2FH21F_06_228 | GATGTCACCTCTCTGCCTTC | 382 | ACGTAAGTCCCACAGTTTG | 1634 | GGGAGGCTTAGGGAGAA | 2886 |
| 2FH21F_06_229 | GGGAGGTCAGGACAATTTTT | 383 | CTCCCAAACTGTGGGGACTT | 1635 | AAACTGTGGGGACTTACGTGT | 2887 |
| 2FH21F_06_233 | ATGGGTGACAAAACGAC | 384 | GAAAATTGCATCTGGCTACAC | 1636 | CAGCTCCTTGGTGTAGA | 2888 |
| 2FH21F_06_238 | TGTGTGCAAGGCTCTAGAAG | 385 | TGTTCTTGGTTGACTTTAC | 1637 | CAAACAGAGAAAATTAAAATCAAACA | 2889 |
| 2FH21F_06_239 | TTTTGCCACTTTCCAGTG | 386 | CTGTTCCTGAGCTGATTGGG | 1638 | TCCTGAGCTGATTGGGGTTCTG | 2890 |
| 2FH21F_06_241 | TTTTGCCACTTTCCAGTG | 387 | CTGTTCCTGAGCTGATTGGG | 1639 | AAGCTCAGGAGGACAAA | 2891 |
| 2FH21F_06_242 | GAAGACAAGTAGCTGACCTG | 388 | AGGACATGGGGCTGGTTTTG | 1640 | GGGAAGGGCCTAGGTG | 2892 |
| 2FH21F_06_243 | GAAGACAAGTAGCTGACCTG | 389 | AGGACATGGGGCTGACCTG | 1641 | AGGACATGGGGCTGGTTTTGGTAAA | 2893 |
| 2FH21F_06_250 | TGTATGACAAGCCATGTGGG | 390 | TCCTGTGTTTCTAGGAAGGC | 1642 | TTCTAGGAAGGCAACACT | 2394 |
| 2FH21F_06_251 | CCTGTCAGTTCAATGTGTAA | 391 | GAAACACAGGAATAACCTGC | 1643 | GGAATAACCTGCAGCACCA | 2895 |
| 2FH21F_06_252 | ACAGGATAACCTGCACGAC | 392 | CCTGTCAGTTCAATGTGTAA | 1644 | AAAAGCACAAAAGTAGATTCCT | 2896 |
| 2FH21F_06_253 | ATTCATCGAATGTGGGCGTC | 393 | GTGCTTTTACACATTGAACTG | 1645 | TGCTTTTACACATTGAACTGACAGGT | 2897 |
| 2FH21F_06_254 | GCAGGATTCATCGAATGTGG | 394 | AGGCATCGACTGTCACAGG | 1646 | CAGGGGCCAGTGACGAGAGT | 2898 |
| 2FH21F_06_258 | CCCACATTCGATGAATCCTG | 395 | AGCTGCCTTTATTCGTGCTC | 1647 | TTTTATTCGTGCTCAAGTTAT | 2899 |
| 2FH21F_06_259 | ACAGGAGCAGTGTTTAGAGC | 396 | ACTTGAGCACGAATAAAGGC | 1648 | CGAATAAAGGCAGCTCA | 2900 |
| 2FH21F_06_263 | CTTTCAGCCTCCAGTTTTTG | 397 | GGCAGCAAAAACATTAATTC | 1649 | AGCAAAAACATTAATTCTCTGCCTG | 2901 |
| 2FH21F_06_264 | AACATTAATTCTCTGCCTG | 398 | TCTTCCTTTCAGCCTCCAG | 1650 | CTTCCTTTCAGCCTCCAGTTTTTG | 2902 |
| 2FH21F_06_268 | CCACTTCTTGTTATAAGCATGGG | 399 | CAAAAAGACCTGCTAGAGCC | 1651 | GCTAGAGCCATTATTGC | 2903 |
| 2FH21F_06_275 | AGACTCAGGAGGATGAAAG | 400 | CATGCTGGAAGTCCAGGCT | 1652 | AAGTCCAGGCTGTACAC | 2904 |
| 2FH21F_06_277 | GGGTCTTGGGTTCTGCTGG | 401 | CAGCAAAGAAAAACCAAGAGTC | 1653 | ACCAAGAGTCAGACACA | 2905 |
| 2FH21F_06_278 | TGGGGCCTGTCTGTCTGGCCTGAG | 402 | TGCCAGCAGAACCCAAGAC | 1654 | AGAACCCAAGACACCCCAGCA | 2906 |
| 2FH21F_06_279 | TGCCAGCAGAACCCAAGAC | 403 | TGTTGGGGCTGGGCCTGT | 1655 | TGGGGCCTGTCTGGCCTGAG | 2907 |
| 2FH21F_06_284 | CTTTTCTCATCTTCCTAATTC | 404 | CTGGCATCCTCGTGAAAGTG | 1656 | ATGGAGGGACTCCTTTT | 2908 |
| 2FH21F_06_288 | ATGTTTCCTGTTCCAGTGC | 405 | TGAAAGGCAGGAACGTGGT | 1657 | AGGCAGGAACGTGGTTTAGAC | 2909 |

TABLE 4A-continued

| | | | | |
|---|---|---|---|---|
| 2FH21F_07_002 | GAAAGGCTTTGGAGATGACC | 406 | GGTTTAGGGACTGAATAAC | 1658 | GGACTGAATAACTTAGTTACATAA | 2910 |
| 2FH21F_07_003 | TGATGAAAGGATTTGAGTGC | 407 | AGTCTATTGGATTTAAACC | 1659 | ACCATTTCCTATAAAACCTGATT | 2911 |
| 2FH21F_07_004 | CCATTTCCTTATAAAACCTG | 408 | CTCAATAGAGTCTTATTGCC | 1660 | GATGAAAGGATTTGAGTGC | 2912 |
| 2FH21F_07_009 | TATCCTGTGTACTGTGAAAA | 409 | TTGCCGCACCATAAATCCAC | 1661 | CACCAATACCTATCCAAAAAGAAATT | 2913 |
| 2FH21F_07_016 | TGTATAAATGCCCTCATAC | 410 | CACAAACTACCTAGATGACAC | 1662 | TGACTGATATGATTTCAGGGGAC | 2914 |
| 2FH21F_07_017 | TGCAGATTTCTTCCAGGAAC | 411 | CCCTCAATTAGAGGGTTGAC | 1663 | GAGGCAGAGGAAAAGAAAA | 2915 |
| 2FH21F_07_018 | GGTCATATCTATAATAAGG | 412 | AAAAGTACACTTATAAGCC | 1664 | ACAACTTATAAGCCTCATCATGAT | 2916 |
| 2FH21F_07_021 | GGTCCTTATTATAGATATGAC | 413 | CATTCGTATTCCATGAGACC | 1665 | TTCCATGAGACCTTAAAAGATAACCT | 2917 |
| 2FH21F_07_022 | GGTCTCATGGAATACGAATG | 414 | GTAAGAGTGATCTAAATCCC | 1666 | TGATCTAAATCCCTTTTGATATG | 2918 |
| 2FH21F_07_025 | CAATTTAAAACCTCATTGG | 415 | CACACGTGTTGAGTAGGCTT | 1667 | TGTTGAGTAGGCTTCCTTAG | 2919 |
| 2FH21F_07_026 | GCCTACAACTTCTGTATTGTG | 416 | TCAGGAGTGGAGAGAAAGC | 1668 | GAGAAAAGCGGTCTTGC | 2920 |
| 2FH21F_07_027 | AAGACCCGCTTTCTCTCCAC | 417 | GGTCCTAGAATTTATAGTC | 1669 | AGTCCAGTTAAAACCATGA | 2921 |
| 2FH21F_07_028 | GGACTATAAATTCTAGGAGC | 418 | TGTTTATGCAGGAGTGCCAG | 1670 | AAGTATACAGTGTGAAGGGGAA | 2922 |
| 2FH21F_07_029 | GTCCAAGTATGAACAAAAGCC | 419 | GTGAATACTTCACAATGAATC | 1671 | TCCCAAATGTTAACCATTTTATTAAA | 2923 |
| 2FH21F_07_030 | GTGAATACTTCACAATGAATC | 420 | GTCCAAGTATGAACAAAAGCC | 1672 | AAATGGTTAACATTTGGGA | 2924 |
| 2FH21F_07_033 | TCAGAATCTAGTCCTGAGCG | 421 | ACACCATCTGTTCCTTCCAC | 1673 | CCACTCCCTTAGTTTCATCAT | 2925 |
| 2FH21F_07_035 | AACACTGCACTAAGCAGCAC | 422 | ATCCCTGTTGGTAGGGAAAG | 1674 | GAAAAGTATGAAAGGAGATAGAAG | 2926 |
| 2FH21F_07_036 | ATCCCTGTTGGTAGGGAAAG | 423 | AACACTGCACTAAGCAGCAC | 1675 | ACTAAGCAGCACAATTTCTA | 2927 |
| 2FH21F_07_037 | AAGGGAACACAGAACTCAG | 424 | AGAGACCTGGACCTGAAGAC | 1676 | AGTGAATTTGTTAAGTGCAAATGG | 2928 |
| 2FH21F_07_042 | CATGAACAGGGTATTTGTC | 425 | GCCATTATCAGATTTGTTATG | 1677 | TTGTTATGGAATTGGCCT | 2929 |
| 2FH21F_07_050 | CCAATGGAAATATTGAGAG | 426 | CCACCTAGGACGTTTTATTG | 1678 | ATTTAGTGGTAGGCAGTGGGG | 2930 |
| 2FH21F_07_052 | GAACTGTCTACTGCCAACAT | 427 | GGTTTTCTCTGAGATTTGGC | 1679 | TGGCTAACATACATCTTAAATTC | 2931 |
| 2FH21F_07_053 | GGTTTT1C1CTGAGATTTGGC | 428 | GAACTGTCTACTGCCAACAT | 1680 | ACTGCCAACATAATATTAAACTAT | 2932 |
| 2FH21F_07_057 | CTGCCCCTGTATAATGTATGG | 429 | ACAGTGTAAAAGTGCTGCA | 1681 | CTGCACTGGATTGTAGG | 2933 |
| 2FH21F_07_058 | TGCTGAACAGGGTGCTTAAC | 430 | CTACAATCCAGTTGCAGCAC | 1682 | CACTTTTTACACTGTAATTAAAGAT | 2934 |
| 2FH21F_07_059 | CTACAATCCAGTTGCAGCAC | 431 | TAAGTGCTGAACAGGGTG | 1683 | TGAACAGGGTGCTTAAC | 2935 |

TABLE 4A-continued

| | | | | | |
|---|---|---|---|---|---|
| 2FH21F_07_061 | TCTGCTGAGCATCTATTATC | 432 | TACTGGTGGAGGCATTAGTG | 1684 | TTGTTTATTGATGAATTCATACACA | 2936 |
| 2FH21F_07_063 | CAGTTTGTAGATTAAGGAGG | 433 | CCACCAGTAATAACCTAGAA | 1685 | ATCTTGAATTCTTCACTTAAAAAAA | 2937 |
| 2FH21F_07_064 | CAGAAAGAAACTTAATGCT | 434 | AAACACTACCTGCAGGGAC | 1686 | GGCAGGGACTGAATTGAACC | 2938 |
| 2FH21F_07_067 | CTCAGGTAAACTGTCCAAGC | 435 | GTTGCTTCTAAATAGCCTATC | 1687 | TAAATAGCCTATCCCTCCAC | 2939 |
| 2FH21F_07_071 | CCAAGGTTGCTTATAAACAG | 436 | CTTTTACCAGTTATCTTCC | 1688 | TCTTCATTGCTTTCACTTTTC | 2940 |
| 2FH21F_07_072 | CTTTTACCAGTTATCTTCC | 437 | CCAAGGTTGCTTATAAACAG | 1689 | GAAAAGTGAAAGCAATGAAGA | 2941 |
| 2FH21F_07_074 | GTAGAACAAGAAATTAGACC | 438 | TTATTGAAGGCTAAAGCTG | 1690 | TATTGAAGGCTAAAGCTGATATA | 2942 |
| 2FH21F_07_081 | GAAAGCAATTAGAACATGA | 439 | ACCCTGTATGTATCATCACG | 1691 | AATGTAATCACACTACTATGATCTA | 2943 |
| 2FH21F_07_082 | GACGTGATGATACATACAGG | 440 | GTATTCCCATTCTAATTAGG | 1692 | AATAATCTTAGGTCTCTTCTTGTAT | 2944 |
| 2FH21F_07_034 | GCAGGATTTCACAAAGATGAG | 441 | CAATATCCAATTTGCTGTCTG | 1693 | CCAATTTGCTGTCTGTCTACTTCT | 2945 |
| 2FH21F_07_088 | ATTTAAAACTGAATATACTTG | 442 | TTCTGTGTTCATGGAACAC | 1694 | ACACATTTTAATGCAGATAATTG | 2946 |
| 2FH21F_07_090 | ATTTGCCACCATGAAACAG | 443 | CAATTCTTTGGTCTTTACCAG | 1695 | CTAACCAAAGAAATGTAGATTTAC | 2947 |
| 2FH21F_07_094 | ACTAAAAGCTGGAGGAGG | 444 | GCCCCTCCTTGTTACTACTTC | 1696 | GCCCCTCCTTGTTACTACTTCATCATTT | 2948 |
| 2FH21F_07_095 | CCAGGTTCAATACATTAGGAC | 445 | TAAGCCTGGAAATACACCCC | 1697 | CCCCTCCCCAATATTC | 2949 |
| 2FH21F_07_105 | AGACAAGGTACCACGAAAGGG | 446 | GGCCTAGTTTTACTGCACAC | 1698 | GCCTAGTTTTACTGCACACGTCTTT | 2950 |
| 2FH21F_07_106 | TGTGAAAATTAGTCTCCTC | 447 | TCCCTTTCGTGTACCTTGTC | 1699 | GTCTTTAGAGAATAAAATATATCTGG | 2951 |
| 2FH21F_07_109 | GCCAAACTTTAATCCATTT | 448 | TCACAATAGTAATTTGGAG | 1700 | TGATTGAAAATTGCTTCAAGT | 2952 |
| 2FH21F_07_112 | CTACCCTTTAAGAATGAGTTC | 449 | CATTTTGCCATGCAGTTTTAC | 1701 | GCAGTTTTACTTAAATCTCACTTA | 2953 |
| 2FH21F_07_115 | CTGCAGTTGTTAGAGGAACC | 450 | GTTTCTAGTGGAAGAGTGAC | 1702 | TTTTCTAGTGGAAGAGTGACAGATTC | 2954 |
| 2FH21F_07_116 | AGTGGAAGAGTGACAGATTC | 451 | CTGCAGTTGTTAGAGGAACC | 1703 | GAATCAAGGCCCTCCAAAATT | 2955 |
| 2FH21F_07_117 | CTGCAGTTGTTAGAGGAACC | 452 | AGTGGAAGAGTGACAGATTC | 1704 | GAGGCCCTTGATTCTTCT | 2956 |
| 2FH21F_07_119 | TTTGGAGGCCCTTGATTCTTC | 453 | TCGTTACACACCAGATCAC | 1705 | ACCAGATCACTGTCAGCAAGA | 2957 |
| 2FH21F_07_122 | TATGCTTCACTTCAGAAGAC | 454 | TATCATCCCAACATACAGT | 1706 | TCCCAACATACAGTGAATAC | 2958 |
| 2FH21F_07_128 | TGTTATGTGAGTTACCTAAG | 455 | CATCTGGGTATCTACTATTAG | 1707 | TGCCTACACATTCTAGATCA | 2959 |
| 2FH21F_07_130 | AGACTCAAAAGCACAGACAG | 456 | GGTTGGCAGGTATGGTTAAG | 1708 | GCAAAATAAATATTGGTGGTTAG | 2960 |
| 2FH21F_07_131 | GATTTCCTGAGATTAGTCTT | 457 | TTTGCTTAACCATACCTGCC | 1709 | CCATACCTGCCAACCTA | 2961 |
| 2FH21F_07_135 | ATCCCAAAGACATTTTTGC | 458 | CCATTGTCAATTCTTTTCCAG | 1710 | ATCTCTTAACTAAAAGATTAGTTAC | 2962 |

TABLE 4A-continued

| | | | | |
|---|---|---|---|---|
| 2FH21F_07_136 | CCATTGTCAATTCTTTTCCAG | 459 | GTCTTTATCCCAAAGACA | TTTATCCCAAAGACATTTTGC | 1711 | 2963 |
| 2FH21F_07_133 | ACCTATCTGACAATGACTGG | 460 | TGCTCCCTGGTGAGCTGGA | CCTGGTGAGCTGGAGTGGGG | 1712 | 2964 |
| 2FH21F_07_142 | CTCTCAAAGAGAATAGCAG | 461 | TCTCAGCTTGTTCTGTCTCC | CCCCTTTGGTGTGCTTCTTT | 1713 | 2965 |
| 2FH21F_07_143 | AATATCTAGTAACTACTGG | 462 | CACCCAGAATTCTCTACCAG | CCCAGAATTCTCTACCAGTTCTCAAGA | 1714 | 2966 |
| 2FH21F_07_147 | GTTGAATGGTTATCTTTTCAC | 463 | GTTACCTCTATTAAGCTTTTC | CCTCTATTAAGCTTTTCAAAAGATA | 1715 | 2967 |
| 2FH21F_07_150 | CATTACATAGAATAAAGAAC | 464 | TGTGGCTGTTATTAGCAAG | GTGGCTGTTATTAGCAAGTAGGTCA | 1716 | 2968 |
| 2FH21F_07_151 | GACCACTATTAATTGTTCCT | 465 | GACCTACTTGCTAAATAACAG | CTTGCTAAATAACAGCCACAAG | 1717 | 2969 |
| 2FH21F_07_152 | GATAGGAACAATTAATAGTGG | 466 | GTTAGATGAAGTCCTTTTACC | GACTTGTTGATTCAACAAGTT | 1718 | 2970 |
| 2FH21F_07_153 | AATTTAACTAAGGTAGGTTT | 467 | TAAACACAAATGCTACACC | ATGCTACACCTTTAAAAGTCA | 1719 | 2971 |
| 2FH21F_07_156 | GGCCAGAGTTCATCACAATC | 468 | AAAGAGCTGCTGGGTAACTG | GGCTACCTGGGAAGTGGG | 1720 | 2972 |
| 2FH21F_07_157 | CTGCAAGCAGTATTACCAGG | 469 | GAGAGAAGCCCCCTCCCCT | CCACCACTCAGGCAGATGCCTA | 1721 | 2973 |
| 2FH21F_07_160 | AAGGCACAGCATTGTCATTG | 470 | ACATCACCCTCCTTTCCCAG | AGGCCCTCCACCTCCTC | 1722 | 2974 |
| 2FH21F_07_161 | TGACCCTCAGTGTGCAT | 471 | AATGACAATGCTGTGCCTTC | TGCTGTGCCTTCCACTCC | 1723 | 2975 |
| 2FH21F_07_164 | AATGCTGTGCCTTCCACTCC | 472 | ATGGAGATGACCCTCAGTG | TGGGCCTGAGCGGGTT | 1724 | 2976 |
| 2FH21F_07_166 | CCTACCTCACTTGGCTTCTG | 473 | ATTCCAAGGGCTATCTCCAC | CCCAACCCGGCTCTGAACGCCTC | 1725 | 2977 |
| 2FH21F_07_168 | AAACATAAGTTAAAGATAAG | 474 | GCATCTTGCTATCTTCTCCC | GCTATCTTCTCCCGATTGTCTAAAAA | 1726 | 2978 |
| 2FH21F_07_176 | AGCTCTTCTTGCTTTCCCTG | 475 | CTCTGTTGAGATTTTTGAC | GATTTTAAATTCAAGAGGAGGGGAA | 1727 | 2979 |
| 2FH21F_07_178 | GTGACTTTTTATGGAGAGG | 476 | GAATGAAATCTGGGGATAA | ACAGGAGAATGGGTCAGTT | 1728 | 2980 |
| 2FH21F_07_179 | GAGTACTTGTCCTCCAAGAT | 477 | GCCTCCAATTATTATTCAG | CCTCTCCATAAAAAGTCAC | 1729 | 2981 |
| 2FH21F_07_180 | CCTCTCATAAAAAGTCAC | 478 | CTTGAAGGAAGAGTACTTG | ACTTGTCCTCCAAGATCTTT | 1730 | 2982 |
| 2FH21F_07_181 | AAAGATCTTGGAGGACAAGT | 479 | CTCAGTTTCTTGGGAAGGAT | TTCTTGGGAAGGATTAAAAGA | 1731 | 2983 |
| 2FH21F_07_183 | AGGACAAGTACTACTTCCTTC | 480 | ATTCAGTAAACATTTATTCG | ATTCAGTAAACATTTATTCGATACCTT | 1732 | 2984 |
| 2FH21F_07_186 | TTGGGCATAATTCTTGCTGG | 481 | ACCCCCATGATTCTAATGAG | GATAATTTGGGATGTTACCAG | 1733 | 2985 |
| 2FH21F_07_187 | ATCCTGGTCAGCATAATTCC | 482 | GGAGAAATGACCAAGAGAGATG | GAGAAATGACCAAGAGATGAAATAC | 1734 | 2986 |
| 2FH21F_07_188 | TTGAGTAGATCCTGGTCAGC | 483 | TGACCAAGAGATGAAATAC | AAATTTGTAAATGCCACATATTTC | 1735 | 2987 |
| 2FH21F_07_194 | ATTCAAAGCTGTGTATTGGG | 484 | GAACAACCTCTATTATTATTAC | ACAACCTCTATTATATTACACAAAC | 1736 | 2988 |

TABLE 4A-continued

| | | | | |
|---|---|---|---|---|
| 2FH21F_07_195 | TTCTGGCACACTTTGCACTC | 485 | TGTGGTCAGCACTATCATGG | 1737 | TCATGGAATGTCCTGGATA | 2989 |
| 2FH21F_07_198 | GCATCATGAAACCTTTCAGAC | 486 | GATTAAATACCCTACAGTG | 1738 | ATACCCTACAGTGTTTTATTG | 2990 |
| 2FH21F_07_200 | GTTACACTGCAAAGCATTTC | 487 | GCTGGATACCTAATTAATGC | 1739 | TACCTAATTAATGCTCAATATATGCT | 2991 |
| 2FH21F_07_202 | GTTACACTGCAAAGCATTTC | 488 | GCTGGATACCTAATTAATGC | 1740 | GAACCAAACAAGGAAAATAC | 2992 |
| 2FH21F_07_203 | GCTGGATACCTAATTAATGC | 489 | GTTTATGTTACACTGCAAAGC | 1741 | CACTGCAAAGCATTTCTTA | 2993 |
| 2FH21F_07_207 | TATGCATAAGTTAACTGTA | 490 | TACTAACAGTTCTTTTACC | 1742 | AAATATAAGGATAAACTGCCCTG | 2994 |
| 2FH21F_07_210 | GTTTCAAGATGCTTGACTGG | 491 | GAAGGTTTGGTCAATCCTAT | 1743 | CAATCCTATCATTTCTCTGACTCA | 2995 |
| 2FH21F_07_211 | GTTTCTTGTAAGCATATGGG | 492 | GAATACCTATTACCACACCC | 1744 | TACCTATTACCACCCAAATACC | 2996 |
| 2FH21F_07_212 | CATCCCAGTTATGTCCTTTC | 493 | TGGCTCTTTAAGTGATAGGC | 1745 | ATCTAACAATGGAAGCATCATAAATT | 2997 |
| 2FH21F_07_214 | TCAGTAAGGAATTGGTGGA | 494 | CTCTGCACAAGACAACTG | 1746 | CTGTCATTGTCACAAAAATCAC | 2998 |
| 2FH21F_07_215 | GTCATTGTCACAAAAATCAC | 495 | CCAATGATCCATAGTAATC | 1747 | TCAGTAAGGAATTGGTGGA | 2999 |
| 2FH21F_07_216 | CCAATGATCCATAGTAATC | 496 | GTCATTGTCACAAAAATCAC | 1748 | TCCACCAATTCCTTACTGA | 3000 |
| 2FH21F_07_219 | CTGGTGTCAAAACACTTAA | 497 | GTTGGAACCAACCTCATTTC | 1749 | TTTCTTTGTGTAGTGCTTTTAAAAAT | 3001 |
| 2FH21F_07_220 | AATGAGGTTGGTTCCAACCC | 498 | GGTTGTTTCAGTATTCCCAC | 1750 | TTCCCACACATCTTCTC | 3002 |
| 2FH21F_07_223 | GAAAGTGATGAGTATTTGAG | 499 | AACCTTGCTCCCTTACTTC | 1751 | CCCTTTACTTCATTTAGCTTCAT | 3003 |
| 2FH21F_07_226 | GCTGTTCACCAATGCTTTTA | 500 | TAGAACAGAGCTTATCACAG | 1752 | GCTTATCACAGATCCTTAAAC | 3004 |
| 2FH21F_07_228 | CCAGACAACACATAAGAAT | 501 | CAATGCTGATTTGGTCCTTC | 1753 | TGACAGCTATTTTGACTTTT | 3005 |
| 2FH21F_07_229 | GAAAGCAATGCTGATTTGGTC | 502 | TAAAAGCATTGGTGAACAGC | 1754 | AATAGCTGTCATACAGTGTGAATT | 3006 |
| 2FH21F_07_230 | TCTAGCCTCTTTGGATGAC | 503 | TTTCATCACTGGCAGGACAC | 1755 | TTTGTCTATAAAAGAGAATCTCTGG | 3007 |
| 2FH21F_07_233 | ACCTTCAGTTGCTGAAGTTAG | 504 | CATTATATACATGATCAACA | 1756 | ATTATATACATGATCAACAACAGCA | 3008 |
| 2FH21F_07_234 | ATACATGATCAACAACAGC | 505 | AGTGTATACCTTCAGTTAC | 1757 | TATACCTTCAGTTACATGTTAG | 3009 |
| 2FH21F_07_235 | CTAACATGTAACTGAAGGT | 506 | ATGGCAGTGCTACTTTCTAC | 1758 | TTCTACTGAAAACTGTGTTCTAA | 3010 |
| 2FH21F_07_238 | TCAATCTGCTGAAGTAACTC | 507 | TGCACTTGCTGAAGTAACTC | 1759 | AGTAACTCAGTACATAAATAGTAGCC | 3011 |
| 2FH21F_07_239 | TGCACTTGCTGAAGTAACTC | 508 | TTGTACACTCCTTCAATCTGG | 1760 | TTCAATCTGGAAGAGAAGAACTT | 3012 |
| 2FH21F_07_240 | GTTTGCCTTACCTATAATTTG | 509 | TGTGTTCCACATATGTAATC | 1761 | CCACATATGTAATCATATCACC | 3013 |
| 2FH21F_07_241 | AAAGGGTAATGATCATGTA | 510 | CTTCTCCAGGTCTGTGAAAC | 1762 | CCAGGCTTAAACTAATCTCAAATAC | 3014 |
| 2FH21F_07_242 | GAGATTAGTTTAAGCCTGGG | 511 | TTTCCTATCTTCTCCAGGTC | 1763 | TTCCTATCTTCTCCAGGTCTGTGAAAC | 3015 |

| | | | | |
|---|---|---|---|---|
| 2FH21F_07_243 | CTTTTTTATGTCACCTCTTAG | 512 | CACAGACCTGGAGAAGATAG | 1764 | CCTGGAGAAGATAGGAAAAAA | 3016 |
| 2FH21F_07_245 | CTTTTTTATGTCACCTCTTAG | 513 | CACAGACCTGGAGAAGATAG | 1765 | AACATTGCTAAGGAACAG | 3017 |
| 2FH21F_07_247 | GAGATCTCTCCTTTTCTTAC | 514 | GGAAATTCAATAGACTAGGAG | 1766 | TTCAATAGACTAGGAGAAAAAA | 3018 |
| 2FH21F_07_253 | GAATTATAAAATACTATTGG | 515 | CCTTTTCATGATTCATCTATC | 1767 | CCTTTTCATGATTCATCTATCTTAGTC | 3019 |
| 2FH21F_07_254 | ACTGGATGGCTTTTTAGTGT | 516 | CCACTGTAGAAAGATGTAA | 1768 | CTGTAGAAAGATGTAAATAGGGACT | 3020 |
| 2FH21F_07_256 | ACACTCAGGGAATTTACAAC | 517 | GACCAAGCTCCTGAAAGATG | 1769 | CTTTTAAACTTCAACCAATGT | 3021 |
| 2FH21F_07_262 | TACAAAATAAACTCATCAATT | 518 | GTTGATTGCTACATTGAAG | 1770 | TTGCTACATTGAAGTATGTAGTTTT | 3022 |
| 2FH21F_07_264 | TTCCCATTTCAACCTGCCTC | 519 | TAGACTGCCCCTCTTGTTTG | 1771 | TTGTTTGGGGCTTATTTCTGTG | 3023 |
| 2FH21F_07_268 | GATCATGTAATGGCATAAGC | 520 | CTCTGTGGGAAATGACTATC | 1772 | TATCTAACATAAATTTTGTTTACACC | 3024 |
| 2FH21F_07_269 | CTCTGTGGGAAATGACTATC | 521 | CTGATCATGTAATGGCATAAG | 1773 | TGATCATGTAATGGCATAAGCAAGTA | 3025 |
| 2FH21F_07_270 | CAAAGATAGTTGGTGCCTC | 522 | CTTATGCCATTACATGATCAG | 1774 | GCCATTACATGATCAGTTTATCTTTT | 3026 |
| 2FH21F_07_271 | GCCATTACATGATCAGTTT | 523 | CAGCATTTTTGGTGCTTTGG | 1775 | GATAGTATGGTGCCTCAA | 3027 |
| 2FH21F_07_277 | GTGGCTCATAAACAGCTTAG | 524 | CCACAGTAATGTTAGCAGGG | 1776 | ATGTTAGCAGGGTCCAACTGTCT | 3028 |
| 2FH21F_07_279 | TGTTTTCAATGTTTTATGTG | 525 | GCAGTAGACTGATGACAGTG | 1777 | GTGAGGAAGAGTTTGATAGTATGTGA | 3029 |
| 2FH21F_07_282 | CCTGTGTTTGTAAAAGCTGGT | 526 | GCTATTTTGGCACTCAAGGG | 1778 | TTTTGGCACTCAAGGGTATTAATG | 3030 |
| 2FH21F_07_283 | ACCAGCTTTTACAAAACAGG | 527 | CTGGGTTCTGTTAATGCACT | 1779 | TATTTAGATACCTTGGGAGTTA | 3031 |
| 2FH21F_07_289 | TAGGAAGATACATTCCAGAC | 528 | AGCTAATGAAGAGCACTCGG | 1780 | CACTCGGCATTAAAAGAAAA | 3032 |
| 2FH21F_07_293 | TTGAAAATTCCTCAGACTC | 529 | CCCATATTAATCAAGAAC | 1781 | CCATATTAATCAAGAACAACACAATAA | 3033 |
| 2FH21F_07_298 | TGGTTTTTAGGCTACGTGCTC | 530 | AAACAAATTTGGAGCATGGG | 1782 | ATTTGGAGCATGGGGAGCCTTA | 3034 |
| 2FH21F_07_302 | TGCTGTTAATGAGATCCGAG | 531 | GAATAATTTCATAGATTAGG | 1783 | TTTTATTTCAGTCAGCTTTATTTC | 3035 |
| 2FH21F_07_303 | GACCTGAAGTAATGAACAGT | 532 | GTGTGTTTAATAGTATGCC | 1784 | GTATGCCAACTAGAATGATTA | 3036 |
| 2FH21F_07_304 | GGCATACTATTAAACACAC | 533 | ATCCCACTCCTTAGCAGTCTC | 1785 | TGTAATGTCGTTTGATGTTATT | 3037 |
| 2FH21F_07_305 | CATAGTGTTAAGACATTGTG | 534 | GCTTTGGTGTCTGCCAAATC | 1786 | GGTCTCTGCCAAATCACTATTA | 3038 |
| 2FH21F_07_306 | GCTTTGGTCTCTGCCAAATC | 535 | CATAGTGTTAAGACATTGTG | 1787 | CATTGTGTAATGTAAGTATAATGT | 3039 |
| 2FH21F_07_307 | ACTCAGAAAGCTTGCCTCTC | 536 | ACTCTGGCTTGGAAATGAGG | 1788 | GAGGAGGCAGAATCTCAGA | 3040 |
| 2FH21F_07_308 | ATGAGGAGGCACTTTTGTGAC | 537 | TAGAGGGCACTTTTGTGGAC | 1789 | ACTCAGAAAGCTTGCCTCTCCTATTTT | 3041 |

TABLE 4A-continued

TABLE 4A-continued

| | | | | |
|---|---|---|---|---|
| 2FH21F_07_309 | AAGTGCCCTCTACCTATTGG | 538 | AGGGACCTATTCTTCAGGG | 1790 | TATGTATGTTGTTACAAATAGAGA | 3042 |
| 2FH21F_07_312 | TATATATAAAATTCACTTGC | 539 | GGGTATTCCTAGAAATGTG | 1791 | TGTACCTATTATTCACTTGCT | 3043 |
| 2FH21F_07_321 | CGAGTTTCTCCAAACAGATG | 540 | TCAACCAGAATCTGGTTCAC | 1792 | ATCTGGTTCACCTTATTGACTCA | 3044 |
| 2FH21F_07_323 | GCAGGTACTGGAAATCTGCT | 541 | TGGTGAACAAACTGTTTGTG | 1793 | TGTTTCCACTTTTCTTAAAAAA | 3045 |
| 2FH21F_07_325 | AATCACAGAAGGGCTATCAG | 542 | GCTGTGATTATATAAATACTC | 1794 | TATATAAATACTCTTTTGATGCATAA | 3046 |
| 2FH21F_07_329 | CTTTGGTACCAATTCTAGAT | 543 | AGAACATGAGACCAGGAAG | 1795 | GAGACCAGGAAGTAAATACC | 3047 |
| 2FH21F_07_331 | ACAAGCTCTATCTTCCTTAC | 544 | GGGAAGTTTTTTGAAGATGGG | 1796 | TTGAAGATGGGAGAAAGA | 3048 |
| 2FH21F_07_332 | TTCTACAGACCAGGCTGTTG | 545 | TCTCCCATCTTCAAAAAC | 1797 | CCATCTTCAAAAAACTTCCCCC | 3049 |
| 2FH21F_07_333 | CTGAAACTTTTTTCAATGCCC | 546 | AAAGTGGTTCAACTGAAAG | 1798 | GTGGTTCAACTGAAAGAATGAAAAG | 3050 |
| 2FH21F_07_334 | TTCAGCCATGTTCAAAAGGG | 547 | GCTTGGGATTCAAGTCATAA | 1799 | AGGTCTGTCTTACCTTTC | 3051 |
| 2FH21F_07_335 | CTTTTGGAGTCTCTCTGCTA | 548 | GAAAGGTAAGACAGACCTAG | 1800 | ATATTTATGACTTGAATCCCAAGCTA | 3052 |
| 2FH21F_07_337 | AACAGAACAAAACTTGATG | 549 | AGATGTTCAATGACATCCC | 1801 | CCCATTTCTTTTGTAAAAGCAACTTGA | 3053 |
| 2FH21F_07_340 | CTGTTCTACAATAGAGGCTT | 550 | GTGAAATCTCAGGATTCAT | 1802 | AATCTCAGGATTCATGTATC | 3054 |
| 2FH21F_07_343 | AAAGAACTGGCAGAATGTGG | 551 | GCTAAAAGCTTTGAGTGATG | 1803 | TAAAAGCTTTGAGTGATGTTTGATTA | 3055 |
| 2FH21F_07_347 | CCATATGGACTTTTGAGCAG | 552 | CAATGTCCATGTCTCCTTCC | 1804 | TATCCCTACCCATTAATACTGTA | 3056 |
| 2FH21F_07_349 | CTCAAAAGTCCATATGTTGC | 553 | AAGTGGATTGTAGCTAGTTG | 1805 | GAATGTCAAGCTTTAGGAATT | 3057 |
| 2FH21F_07_351 | TCAAAAGCCATTCAGGCTTC | 554 | CATGGCTAGAATCTGGTTTCC | 1806 | ACTGTTATTCTGAGTTGAATGC | 3058 |
| 2FH21F_07_352 | CATGGCTAGATCTGGTTTCC | 555 | TCAAAAGCCATTCAGGCTTC | 1807 | TCAACTCAGAATAACAGTAAG | 3059 |
| 2FH21F_07_354 | AACCAGATCTAGCCATGTTC | 556 | GAAGTAGAAAGGCAAATAGGG | 1808 | GACAGTGGCATGGAGCCAAC | 3060 |
| 2FH21F_07_355 | GTTCAGAGAAGTAGAAGGC | 557 | GTTGGCTCATGCCACTGTC | 1809 | GCCACTGTCCCTTATTATAAC | 3061 |
| 2FH21F_07_356 | TGAGGTGACTCTGTGTTTGG | 558 | CCCCTATTTGCCTTTCTAC | 1810 | CCTTTCTACTTCTCTGAACTC | 3062 |
| 2FH21F_07_357 | GCCTTTCTACTTCTCTGAAC | 559 | CTGAGGTGACTCTGTGTTTG | 1811 | GTGTTTGGGTTTTTGAAAAGAT | 3063 |
| 2FH21F_07_358 | AACCCAAACACAGAGTCACC | 560 | CCTGAAAGCCACAGGCATTG | 1812 | TGAAAGCCACAGGCATTGGGTGGGT | 3064 |
| 2FH21F_07_359 | GAATCTATCATAATCTTCAGC | 561 | CCTGTGGCTTTCAGGTCATT | 1813 | CAATTTTACTGGTTCTCTTTAGA | 3065 |
| 2FH21F_07_360 | CTCAATTTTACTGGTTCTC | 562 | CCCATTCAGCTTACTAATGA | 1814 | ATCTATCATAATCTCAGCTGT | 3066 |
| 2FH21F_07_365 | TACAGGAATGTAGGAAGATG | 563 | GCAGTCTTACAAAACCTAAGC | 1815 | TACAAAACCTAAGCAACCTT | 3067 |
| 2FH21F_07_366 | GCAGTCTTACAAAACCTAAGC | 564 | TACAGGAATGTAGGAAGATG | 1816 | AAATGCTTTTCCCACAGATA | 3068 |

| | | | | | |
|---|---|---|---|---|---|
| 2FH21F_07_367 | CTGTGGGAAAGCATTTTAG | 565 | AGTGAGAGTCACCAACATAG | 1817 | ACAGGAATGTAGGAAGATG | 3069 |
| 2FH21F_07_368 | CTTCCTACATTCCTGTAATC | 566 | CCTAGGATTTCTGGTTCAGC | 1818 | AAAGTGAGAGTCACCAACATAG | 3070 |
| 2FH21F_07_369 | TATAATCCCTCCTTTCCCAG | 567 | CATAGGCTGAACCAGAAATC | 1819 | TCCTAGGAAAAACTGATGA | 3071 |
| 2FH21F_07_370 | TATAATCCCTCCTTTCCCAG | 568 | CATAGGCTGAACCAGAAATC | 1820 | AGAAAGCTAAGGGGAAGGA | 3072 |
| 2FH21F_07_371 | CTAAGTGTATGCTCTGTGCC | 569 | CCTGGGAAAGGAGGGATTAT | 1821 | GGAGGGATTATATTACACATGTTA | 3073 |
| 2FH21F_07_373 | TCGGATCCTTCTTCTAGAGTC | 570 | TCTAGCCTTGTTAGTTGCCC | 1822 | AGTTGCCCAAATTCTGAAAAAAA | 3074 |
| 2FH21F_07_374 | AAGGAGATCCGAGAGGCAGA | 571 | TTGGCATTACTCCTGATTCC | 1823 | ATTACTCCTGATTCCTCCTTC | 3075 |
| 2FH21F_07_375 | GACTCATGATGCCCCTTTTC | 572 | GGAGGAATCAGGAGTAATGC | 1824 | GTAATGCCAAGAATGAGAA | 3076 |
| 2FH21F_07_376 | GCACTGATCCACCACTAGC | 573 | CTGTATAGGACAGTATCTGG | 1825 | AATACCCAAAGACAAGATCTCTAAAG | 3077 |
| 2FH21F_07_377 | AAGTAACACTATTCTGTGG | 574 | AGTATTCTTAAAATATACAC | 1826 | CTTAAAATATCACTTTAATATGCCA | 3078 |
| 2FH21F_07_380 | GATTTCAGTATATATGTAG | 575 | TTAATGTAGGTGCAGTTCAG | 1827 | AATGTAGGTGCAGTTCAGTAATGATT | 3079 |
| 2FH21F_07_381 | TTGGCATACTAGTATATGT | 576 | CATTACTGAACTGCACCTAC | 1828 | GAACTGCACCTACATTAATCA | 3080 |
| 2FH21F_07_385 | TCAGTTTTACTCCCCAGAGG | 577 | GTCTTATCTACAAACCAAA | 1829 | TATCTCAAAACCAAAAACATCT | 3081 |
| 2FH21F_07_391 | TCTAATCAGGAGATTTTGG | 578 | CCAGGTATTCTTCAGGTTAG | 1830 | TTCAGGTTAGAACTCAGTTCACAA | 3082 |
| 2FH21F_07_393 | GGATTTAAAATGGACCAGC | 579 | CTTTTTTTTAAACTAGCAGGG | 1831 | GTGAATAGTGGGATTACAGA | 3083 |
| 2FH21F_07_394 | CACTGTTGTATACTTCGTAGC | 580 | GGAAGTAGAAACTGAAGAAC | 1832 | GTAGAAACTGAAGAACACTTTGTTAA | 3084 |
| 2FH21F_07_395 | GTATGTATATGATAAAGCTAG | 581 | AAGCTCCTCAAAAGAGAGTGG | 1833 | TCCTCAAAAGACTGGAGTATAAA | 3085 |
| 2FH21F_07_397 | CACTAAGGCCTTTCCAAT | 582 | TTATCTGTTCTCCCCTACCC | 1834 | CTCCCCTACCCCCCACAAC | 3086 |
| 2FH21F_07_398 | ATTGGAAAGGCCTTAGTG | 583 | GTAGTAGTATGTGAGTTTGG | 1835 | GTAGTATGTGAGTTTGGATCATTTCT | 3087 |
| 2FH21F_07_399 | TCATTTTAGTTTGGAGAAC | 584 | GATCCAAACTCACATACTAC | 1836 | AAACTCACATACTACTACTTCTTATT | 3088 |
| 2FH21F_07_402 | TAGTATTAGTAAACAACTC | 585 | TGAGAACAGTTCCATAGCCC | 1837 | CCATAGCCCTTCATTTTTA | 3089 |
| 2FH21F_07_403 | GGGAGGGCATTCACACAAA | 586 | GCCCAGTGTTTAATGAACTTG | 1838 | CACATCAGAACCACCAG | 3090 |
| 2FH21F_07_405 | GCAGAGTCCAATGCATAATT | 587 | AAGATAACTACCTGGCATTC | 1839 | AACTACCTGGCATTCAGGTTAAAAT | 3091 |
| 2FH21F_07_406 | CCTGGCATTCAGGTTAAAAT | 588 | TGAAATTACAAGTAGGGGC | 1840 | AAGTAGGGGCTGGTGAT | 3092 |
| 2FH21F_07_407 | CTGATCTCAGAGTTTAAAACC | 589 | GTAAATAATTTTTGCATGCT | 1841 | AATAATTTTTGCATGCTAAGAAA | 3093 |
| 2FH21F_07_416 | GCATAACTGTTCTCAACCTTG | 590 | CCTTTCCTTTCCCTTTATG | 1842 | CTTTATGTGCTTACATCTGTCATTTCT | 3094 |

TABLE 4A-continued

| | | | | | |
|---|---|---|---|---|---|
| 2FH21F_07_419 | GAGAGACGCTGCACGTGGA | 591 | CGCCCGCACTCCAGAGCC | 1843 | TCCAGAGCCGGCTGAGAAC | 3095 |
| 2FH21F_07_420 | GTTCCAGATGACTCCAGAGA | 592 | ACCACACTCAACATTTCGGG | 1844 | AGAAGATTTTTTCAGCGGGTCCTC | 3096 |
| 2FH21F_07_421 | GTGCAATCTGCTACACCTAC | 593 | GAAATCCTCGGCGGCTCTTG | 1845 | TCTTTGTACTTTGGCTGC | 3097 |
| 2FH21F_07_422 | CTGTTCTGTTCCCAGGTGAG | 594 | GCAGCCAAAGTACAAAGAGC | 1846 | AGTACAAAGAGCGCCGAGGATTCAG | 3098 |
| 2FH21F_07_423 | TGTGTACAAGTTTGTCTGTG | 595 | CACATTCTGTGACCAAACGG | 1847 | CAACTCCGCTGCACTGTATCCA | 3099 |
| 2FH21F_07_426 | GTTAAAGGATCTCCACAAT | 596 | GCTACACATTAATACTGACC | 1848 | ATTCCACAAATGAACCTGCCTTCACAC | 3100 |
| 2FH21F_07_427 | CTGGCTATTTTTGGTAGGGC | 597 | TGAAGGCAGGTTCATTGTGG | 1849 | AAGGCAGGTTCATTGTGAATAGTTT | 3101 |
| 2FH21F_07_429 | TCTCTAGGAAACAGTCTGGC | 598 | CATCTAAAGCAGCAGAGAGG | 1850 | AGGGGAAACAGTTATATTTTCAAA | 3102 |
| 2FH21F_07_430 | CCCTCTGCTCTTTAGATG | 599 | GATTAGATGAAACAGGCACAC | 1851 | TAGATGAAACAGGCACACATGCTTTA | 3103 |
| 2FH21F_07_431 | AAACCTGGATCTCCTCCTTC | 600 | TGCAAGCAAAGGACAGTAAG | 1852 | TGCAAGCAAAGGACAGTAAGAAGTTG | 3104 |
| 2FH21F_07_434 | AACTGAAAAGTATACCTC | 601 | AATAAACTGGCACTACAGGG | 1853 | AAAAAGGAAGCCATAACAAACCAAA | 3105 |
| 2FH21F_07_437 | GTCTTAAAGAGAGACTGCC | 602 | AGTACTTTACCTTTCAAGGC | 1854 | TGCAAATAGTTTTAAAAGGAAAT | 3106 |
| 2FH21F_07_438 | AGTACTTTACCTTTCAAGGC | 603 | GTCTTAAAGAGAAGACTGCC | 1855 | AGAGAAGACTGCCTATAACA | 3107 |
| 2FH21F_07_439 | TGATCAACTACTGAATATGTATA | 604 | TAGGCAGTCTTCTCTTTAAG | 1856 | AAGACATACTTTCCACTT | 3108 |
| 2FH21F_07_443 | AATAGCTATCTGCCAGTCTC | 605 | CAAAAATGCTAGAAATGTC | 1857 | TGTCTTTTTTCTTTCTTTCTCT | 3109 |
| 2FH21F_07_444 | TAACATGCCATCTTGCCTG | 606 | AAAGCTTCTTAAGAGCTCAG | 1858 | TGACTTAACTAGGAGAAAAG | 3110 |
| 2FH21F_07_445 | GAATGAATCCTAAGAGGCAG | 607 | AAGATTACCAGAGAGAAGAG | 1859 | GATTACCAGAGAAAGAGATCAAAGAT | 3111 |
| 2FH21F_07_447 | CCTTTCTTGCTGTCTATTTG | 608 | AATTTGGGCACTGTGGTT | 1860 | ATGAAATAATAAACAGAAGCTCTA | 3112 |
| 2FH21F_07_452 | CTCATAATTTGAACAGAGAC | 609 | TGTCATGCATAAATGATGG | 1861 | AAAAAGCATCTGATCATGTA | 3113 |
| 2FH21F_07_454 | CCAATCATTATCATGACA | 610 | GAGTTTCTTGAATCAACTGG | 1862 | AATCAACTGGAGAAATTAGTCA | 3114 |
| 2FH21F_07_457 | GAAGATCAACCACACATAGC | 611 | ATATTTGTTGTTGGCATCAG | 1863 | TGTTGGCATCAGAAAAACAAAT | 3115 |
| 2FH21F_07_459 | TATTTTTTG1ATCAGTCTATG | 612 | AATCAGGGGAGAAAAACAA | 1864 | AATCAGGGGAGAAAAATATTGGTGGTACA | 3116 |
| 2FH21F_07_460 | GTTTAGTTGTTTTCTCCCCTG | 613 | CAGCAGACCTCACAAAAATA | 1865 | CTCACAAAAATATTGGTGGTACA | 3117 |
| 2FH21F_07_462 | CCCACTATTCAGACATTAG | 614 | GTCTTTTTAAATGAGGCCTG | 1866 | TAAATGAGGCCTGTCATTATGTCATC | 3118 |
| 2FH21F_07_463 | CTCAGTGAATGCTGAGATT | 615 | CAGGCCTCATTTAAAAAGAC | 1867 | AAACCATGTGTATTTCTACAA | 3119 |
| 2FH21F_07_464 | GGCAAACATAATTTGGATGGG | 616 | AGTTAGTTCTTAAGTTAC | 1868 | GGTAGTTCTTAAGTTACCAAAATC | 3120 |
| 2FH21F_07_465 | GTTCTCTAAGTTACCAAAATC | 617 | CATGGGCAAACATAATTTGG | 1869 | AAACATAATTTGGATGGTCT | 3121 |

TABLE 4A-continued

| | | | | | |
|---|---|---|---|---|---|
| 2FH21F_07_466 | GCTTCTACCAAGTTTATTTG | 618 | CTCCCATTATTACTCTTCAG | 1870 | GTAGAAATAACTTTGGGGTAACAA | 3122 |
| 2FH21F_07_474 | GAATTGCTAACATTTCCAT | 619 | GCAAAGTACATTCCTTTCTG | 1871 | GTACATTCCTTTCTGTGGTATTT | 3123 |
| 2FH21F_07_475 | GTTTGAAATTCTGAATTTGC | 620 | CTTTGCAGCTGTGGTGAGAAGG | 1872 | CTGGTGAGAAGGCAATAAAAGTTGA | 3124 |
| 2FH21F_07_476 | TTCATCTGCATAATTTAATC | 621 | GAAAAACTAAAGTCTAACAG | 1873 | TAAAGTCTAACAGGGGAAA | 3125 |
| 2FH21F_07_479 | TGTTTTATACAGCTCTCAG | 622 | TGTTCTAGAAACAGTGCCTT | 1874 | AAACAGTGCCTTTTCAT | 3126 |
| 2FH21F_07_480 | AAAGGCACTGTTTCTAGAAC | 623 | GTTACTCAAAGCTGTGCAGG | 1875 | AAGCTGTGCAGGGTAAATG | 3127 |
| 2FH21F_07_482 | TTACCCTGCACAGCTTTGAG | 624 | CTCAAGCTTTAAAATTGACC | 1876 | CTCAAGCTTTAAAATTGACCCTG | 3128 |
| 2FH21F_07_483 | GAGGGACAGACAGCTCTTC | 625 | CAGGGTCAATTTTAAAAGC | 1877 | TCAATTTTAAAAGCTTGAGAAG | 3129 |
| 2FH21F_08_001 | ACTTCACAGAACCGTTCCC | 626 | TCTTTCTCCTTCTGAGATGC | 1878 | CCTTCTGAGATGCATCTTCAAAC | 3130 |
| 2FH21F_08_003 | CACATCTTCCTGGATTGGAG | 627 | AAATATTCTGCTTGAATCC | 1879 | TACTCTGAAGAATTTTTGAA | 3131 |
| 2FH21F_08_004 | ATACTCACAGTCTTAGATG | 628 | GGATTCAAGCAGAATATTT | 1880 | TTTTTTCAAAGATCAGTAAGCGGTGC | 3132 |
| 2FH21F_08_008 | TTAGCTCCATGACAGACCAG | 629 | CCAAAGTAGGTTTTTGTAGC | 1881 | GGTTTTTGTAGGTGTAAACTGTG | 3133 |
| 2FH21F_08_009 | GCTGAAGGAATAACACTTAC | 630 | TACAGCTACAAAAACCTAC | 1882 | TACAAAAACCTACTTTGGTATT | 3134 |
| 2FH21F_08_010 | GCTACAAAAACCTACTTTGG | 631 | CAGTGAATATTTTGCTGAAGG | 1883 | TTGCTGAAGGAATAACACTTACA | 3135 |
| 2FH21F_08_013 | CTGCTTTAATGCAATCAAG | 632 | TGCATTAGAAGCTTACCTG | 1884 | CATTAGAAGCTTACCTGAAATCT | 3136 |
| 2FH21F_08_014 | TCTTCATAAACTACTACAATA | 633 | TAGTAAATTTCATCTGTG | 1885 | CATCTGTGTAAACTTTATTGAG | 3137 |
| 2FH21F_08_016 | GGGTTGGATTTGCATCCTAA | 634 | GTAAAACATTATACAGCTC | 1886 | GGAAACAGCTTTCTAATTTTT | 3138 |
| 2FH21F_08_017 | ATGGTGACATTTGAGCAG | 635 | TGCATCAAGCATCTGAGAA | 1887 | CAAGCATCTGAGAATACAT | 3139 |
| 2FH21F_09_004 | GTGTGTATAATGTTTGCCTC | 636 | CCATAAGTTTTAGGCTGTACC | 1888 | TTAGGCTGTACCAACAA | 3140 |
| 2FH21F_09_005 | CCATAAGTTTTAGGCTGTACC | 637 | CCATTGTGTATAATGTT | 1889 | CCATTGTGTATAATGTTTGCCTCT | 3141 |
| 2FH21F_09_007 | GAGGCAAACATTATACACAC | 638 | CATATTTGTCTGTGTACTTG | 1890 | CTGTGTACTTGTGCTCT | 3142 |
| 2FH21F_09_010 | CTGTGTCAAATATGTGACTG | 639 | ACAAATATTGACAGGCAGCA | 1891 | GACAGGCAGCAGATTAT | 3143 |
| 2FH21F_09_013 | CCATGGTCAGTAATAGTTTG | 640 | TTCCCACCAGGTTTCAGGC | 1892 | GGGTTAGAGTTACATTTTCAG | 3144 |
| 2FH21F_09_016 | AATTGTGGTTATTGTATTTC | 641 | GGAAGTTAATTGGGAATAA | 1893 | ATTGGGAATAAAAAGATTTATCAATT | 3145 |
| 2FH21F_09_018 | TGCAGACAGACATGGTCC | 642 | GATGTGAATAAACACAAGC | 1894 | TGTGAATAAACCAAGCTGATAA | 3146 |
| 2FH21F_10_003 | CTTTCAAGAAGTTCATACT | 643 | ATGTTCAAAAATGGTCTGA | 1895 | AATGGTCTGAAAAATAAATGCTTA | 3147 |

TABLE 4A-continued

| | | | |
|---|---|---|---|
| 2FH21F_10_005 | TCAGACCATTTTTGAACAT | GAACAGCTATATTTCAAACCC | 644 | ACAGCTATATTTCAAACCCTTTTA | 1896 | 3148 |
| 2FH21F_10_006 | GGGAAATGGCCATTCAATAC | GGGTTTGAAATATAGCTGTTC | 645 | AGCTGTTCTTTATGCATAAAA | 1897 | 3149 |
| 2FH21F_10_007 | GTATTGAATGCCATTTCCC | ACTGCATTCTTAGTGTAGC | 646 | AAATAAATTCAGATTGAGACATCTT | 1898 | 3150 |
| 2FH21F_10_011 | TTAAACAGTGTACAAGTAA | GTAGACTGTTTAATGACTGG | 647 | AATGACTGGATATCTTCCT | 1899 | 3151 |
| 2FH21F_10_016 | AGGCCAGGGAGCCCACAG | CTGAGTCCTTCAGAGTGTC | 648 | CCAACAATGAAGCCATT | 1900 | 3152 |
| 2FH21F_10_018 | AGACATTGATGCCAGCTCAG | ACACTCTGAAGGAACTCAGG | 649 | TAATCATCCTCCTCCTTGGCTGCT | 1901 | 3153 |
| 2FH21F_10_019 | ACACTCTGAAGGAACTCAGG | AGACATTGATGCCAGCTCAG | 650 | GATGCCAGCTCAGCCATGGACAC | 1902 | 3154 |
| 2FH21F_10_020 | GGCACAGGATGTGGAACTT | GTATCATGGAGTTGGAGAAG | 651 | ACTTCAAGGATCTCTATGGGGA | 1903 | 3155 |
| 2FH21F_11_001 | GGGCTGAGCATCCCATCCT | TGAAAGACATGGTGTTG | 652 | AAAAGAAAGAGCAGTTACACA | 1904 | 3156 |
| 2FH21F_11_002 | TGAAAGACATGGTGTTG | GGGCTGAGCATCCCATCCT | 653 | ACACCTGTTCCAACTGTTC | 1905 | 3157 |
| 2FH21F_11_003 | GGGCTGAGCATCCCATCCT | GAAAAGAAAGAGCAGTTACAC | 654 | GAACAGTTGGAACAGGTGTTTG | 1906 | 3158 |
| 2FH21F_11_005 | GACTCCAGCTCCTGGTACAA | ACAGTTGAACAGGTGTTTG | 655 | GATGCTCAGCGCCCTGCCAG | 1907 | 3159 |
| 2FH21F_11_006 | GGCCAGTTTATTAGAAAGA | ATCGGTACAGTTGAAATGGG | 656 | AATGGGAACTTTTTCAGAG | 1908 | 3160 |
| 2FH21F_11_007 | GAAGTCGCTTGCCAAGGG | GGAATTGGTTATAACACCCG | 657 | ATAACACCCGTTGGAAAG | 1909 | 3161 |
| 2FH21F_11_009 | GGAATTGGTTATAACACCCG | GAAGTCGCTTGCCAAGGG | 658 | TGATCTCAGCATAATGGTAA | 1910 | 3162 |
| 2FH21F_11_010 | GAAAGGGTTTCCAGGTCAA | GGCTATGAAGAATGTATTG | 659 | GAAGAATGTATTGAGAGGC | 1911 | 3163 |
| 2FH21F_11_012 | GGCTCTTTAGTTGAGTGC | AGGAGCTAAGAGCCCAAATC | 660 | GCCCAAATCCTTATGAAGGATGAC | 1912 | 3164 |
| 2FH21F_11_013 | GTTTCCATGAAGAGTCTGA | GCTCTTAGCTCCTCCTTCTCTC | 661 | CCTTCTTCTCTACTCACTT | 1913 | 3165 |
| 2FH21F_11_014 | TCAGACTCCTCATGGAAAC | TGAGGTCTGTTTTTTCTGGC | 662 | AAGTCTACTATGATTCCTTAGAAGTC | 1914 | 3166 |
| 2FH21F_11_015 | CATTTTTCAGGTCAGGTCGT | TCAGACTCTTCATGGAAAC | 663 | GACTTCTAAGGAATCATAGTAGACTT | 1915 | 3167 |
| 2FH21F_11_019 | TTCAACCACAACATCTAGCA | GAAGATAAAATAACAGTCCAC | 664 | TAACAGTCCACTTTATAAACC | 1916 | 3168 |
| 2FH21F_11_020 | ACAGTCCACTTTATAAACC | ATTATTTCAACCACAACAT | 665 | AACCACAACATCTAGCA | 1917 | 3169 |
| 2FH21F_11_022 | ACTGAAGTCATTCATTAGG | GGAATGTTCCACCTTTCTAC | 666 | TGTTCCACCTTTCTACCTTTTTT | 1918 | 3170 |
| 2FH21F_11_023 | GAATGTTCCACCTTTCTACC | GAAACTGAAGTCATTCATT | 667 | CTGAAGTCATTCATTAGGTAA | 1919 | 3171 |
| 2FH21F_11_024 | ACCTAATGAATGACTTCAG | CAGTCCTCAAGTTCACCAAG | 668 | GAAACTGAAGTCATTAGCATAT | 1920 | 3172 |
| 2FH21F_11_026 | ATGCATTCAGTTTCCAGTAG | TGCACTTTCCAGACAAGCAG | 669 | TCAGTCCTCAAGTTCACCAAGT | 1921 | 3173 |
| 2FH21F_11_027 | ACTTGGTGAACTTGAGGAC | AAAGGTCTGCAAGGAACCAC | 670 | TCCAGACAAGCAGGCCAAGAAACT | 1922 | 3174 |

TABLE 4A-continued

| | | | | |
|---|---|---|---|---|
| 2FH21F_11_028 | GTATATATAACTCCTGATC | CTGTGTCAATGGCACATCTG | 1923 | ATGGCACATCTGAATTACT | 3175 |
| 2FH21F_11_029 | ACTCAGATAAAAGTCTTTC | GTAATTCAGATGTGCCATTG | 1924 | TGCCATTGACACAGGAGACC | 3176 |
| 2FH21F_11_030 | AATAGGATTTAATTGTTGTT | ATTCATTTAATCTGGCAATT | 1925 | CATTTAATCTGGCAATTTAATTT | 3177 |
| 2FH21F_11_033 | AGATTTTCCATAGAGTGCTG | TCTTATTCCTGGAACCA | 1926 | TTTCCTGGAACCAGGATAAA | 3178 |
| 2FH21F_12_003 | GCGCTGCCACTAGAGCTG | TGAGGTGTGTCTGGCTGTC | 1927 | TGTCCATCAGCCTCTCTCTCC | 3179 |
| 2FH21F_12_011 | CTCCTCGTGGGGTCCACC | AAGGCGGAAGAGGTGGGATG | 1928 | GGATGCTGCTGCCTGCGGT | 3180 |
| 2FH21F_12_012 | CTGCTTATGCACATCAACGG | AAAGGTGAGCCAATGGGGTA | 1929 | GGTGAGCCAATGGGGTACAAAAT | 3181 |
| 2FH21F_12_013 | AATCTTCAGGCACAACCAGG | ACCCCATTGGCTCACCTTTC | 1930 | CACACTCCTTCCCCGCC | 3182 |
| 2FH21F_12_015 | CCAGGCAACGCCCTGAT | TCTGCCTTACGACCAAAAGC | 1931 | CTGTGGCAAATTTGAGT | 3183 |
| 2FH21F_12_016 | CGCACTTGGCAGAGTGGAG | AGGCGGATGAGTGAGGCAG | 1932 | GCAGGCCCCTCCCACTC | 3184 |
| 2FH21F_12_032 | GAATCAGAGAATGTGATCACT | TGAGCTATTGTCCCTCCAG | 1933 | CTATTGTCCCTCCAGCCTTTGGCCCT | 3185 |
| 2FH21F_12_036 | GAAAAAAGACTAGATGCAGGG | GTTTAATTTACTGGTGCCC | 1934 | TTTACTGTGCCCACAAGAAAAAAA | 3186 |
| 2FH21F_12_039 | CCAGCAGTCCTTAGGATTAC | AICTCATCTCCAATTTTAC | 1935 | TCTCCAATTTACTTTTTTTTTTCCCT | 3187 |
| 2FH21F_12_048 | TGACCTGCTGCCTCTGCTTG | CAGCTTTGATTCTTAAACCCC | 1936 | TTAAACCCCTTTACCCCAA | 3188 |
| 2FH21F_12_049 | AAGAGGGAAGATGACTTTTC | CTTCCTGTGAACCTGCTTTC | 1937 | GCTATCTTACTTTTCTTTATTCCAC | 3189 |
| 2FH21F_12_050 | GCAGGTTCACAGGAAGTTTC | CTTCAAGGCAATCTTTCTCC | 1938 | TCCACTATTTAAAAACAAAACAAA | 3190 |
| 2FH21F_12_051 | CTTCAAGGCAATCTTTCTCC | GCAGGTTCACAGGAAGTTTC | 1939 | TTGTTTTGTTTTTAAATAGTGGAAAG | 3191 |
| 2FH21F_12_052 | GCAGGTTCACAGGAAGTTTC | CTTCAAGGCAATCTTTCTCC | 1940 | AGGCAATCTTTCTCCATAAACATA | 3192 |
| 2FH21F_12_053 | GAAAGATTGCCTTGAAGATG | CTCCACTTGTGCTCTTTATTC | 1941 | TTCTTGAATTTTGATCATCTCT | 3193 |
| 2FH21F_12_054 | TTGCCTTGAAGATGCAAGAG | CTCCACTTGTGCTCTTTATTC | 1942 | TGCTCTTTATTCTATCACTTTCTGCT | 3194 |
| 2FH21F_12_057 | TCAGAGCTTAGCTGACTGG | GCAGGCTTCAGGATAATTATG | 1943 | GGATAATTATGTTGGAGTGC | 3195 |
| 2FH21F_12_058 | CAGGCTTCAGGATAATTATGG | ATGGAAAAGGGATGCAAAG | 1944 | AGCTTAGCTGCACTGGTT | 3196 |
| 2FH21F_12_060 | GCACAAGCTGATCAAGAT | GAGGATAGTCTTCCCTGATG | 1945 | ACCACAACTTGGCAGCCAC | 3197 |
| 2FH21F_12_064 | CATCAGGGAAGACTATCCTC | CTAAAGTCCAGTTCCTCCTC | 1946 | CTCCCACAACATTTGGCCTT | 3198 |
| 2FH21F_12_066 | CGCCATCTAGAGAAGATGGG | GCCAGCCAACTCTTGAAATG | 1947 | AGTTCAGGATGCTTGA | 3199 |
| 2FH21F_12_068 | CTGATCTAAGCCATCTTAT | GACAATGACACGTACCCC | 1948 | TCTTTAACATACTTCTGGAACA | 3200 |

TABLE 4A-continued

| | | | | | |
|---|---|---|---|---|---|
| 2FH21F_12_071 | GGGATGTACGTGTCATTGTC | 697 | GCTTTGCATTCTCCATCTG | 1949 | TGCATTCTCCCATCTGTTGAACAA | 3201 |
| 2FH21F_12_072 | TTTGCATTGGCCTCACAGAC | 698 | ATATCCTGGGGATGGATGTG | 1950 | ATATCCTGGGGATGGATGTGTGGC | 3202 |
| 2FH21F_12_073 | ATATCCTGGGGATGGATGTG | 699 | CCTACATTTGCATTGGCCTC | 1951 | ATTTGCATTGGCCTCACAGAC | 3203 |
| 2FH21F_12_074 | CTGTGAGGCCAATGCAAATG | 700 | ACCAGCTACATCTAGATTAC | 1952 | ACATCTAGATTACAAGCCTTAT | 3204 |
| 2FH21F_12_075 | CAGAGGTAGAAGGAGGC | 701 | GAGGCCAATGCAAATGTAGG | 1953 | CTAGATGTAGCTGGTATCA | 3205 |
| 2FH21F_12_076 | TGTAATCTAGATGTAGCTGG | 702 | GAGAGCAGGGACATACGC | 1954 | CAAGAGGTAGAAGGGAGGC | 3206 |
| 2FH21F_12_077 | GCCTCCCTTCTACCCTCTG | 703 | ACTAGTCTCACTGGCAGTGG | 1955 | GAGAGCAGGGACATACGC | 3207 |
| 2FH21F_12_078 | ACTAGTCTCACTGGCAGTGG | 704 | GCCTCCCTTCTACCCTCTG | 1956 | CGTATGTCCCTGCTCTC | 3208 |
| 2FH21F_12_079 | AACAGAGCTGGAACTTGCAC | 705 | GTCCACTGCCAGTGAGACTA | 1957 | CAGTGAGACTAGTGAGC | 3209 |
| 2FH21F_12_080 | CTGTCAACAGAGCTGGAAC | 706 | TGCCAGTGAGACTAGTGAGC | 1958 | ACTGCTGTTGACACAT | 3210 |
| 2FH21F_12_081 | TGAACAGCATTGCAAGTTGG | 707 | GGACTGACTTCCACTGGTAAT | 1959 | CAAAACCCTTGTAAAACTTTCTTTCTT | 3211 |
| 2FH21F_12_082 | TTCTATACCCCACCTATTCT | 708 | ATTAGTTGGAGAGTGGGA | 1960 | GGAGAGTGGGAGATAGA | 3212 |
| 2FH21F_12_083 | TTGGAGAGTGGGAGATAG | 709 | TTTCTATACCCCACCTATTC | 1961 | TGAAAGTAACATCTTACTAGC | 3213 |
| 2FH21F_12_084 | TTTCTATACCCACCTATTC | 710 | TTGGAGAGTGGGAGATAG | 1962 | TACTTTCATTTACAAATCCTACA | 3214 |
| 2FH21F_12_086 | GGGTATAGAAAAATGTCAGG | 711 | AAGTATTTGTTCCTCATGG | 1963 | TAGCAATTTAAAAGGGTAACT | 3215 |
| 2FH21F_12_088 | GTTACCCTTTTAAATTGCT | 712 | CAAAAACAAAGCAAGGAC | 1964 | AAAAAAGTATTTGTTCCTCATGG | 3216 |
| 2FH21F_12_094 | AGGGCATATTCCATGTCTTC | 713 | ATGTGCAGAAGGATGGAGTG | 1965 | GAAGGATGGAGTGGGATGGT | 3217 |
| 2FH21F_12_095 | TGGCAGGACCTGAAGGATCA | 714 | ATCCCCACTCCATCCTTCTG | 1966 | CCATCCTTCTGCACATC | 3218 |
| 2FH21F_12_098 | GGGTCCTCGAAGCGCACG | 715 | AGGACCTGTTCTACAAGTA | 1967 | GCCAGATCGAGCTCAAGA | 3219 |
| 2FH21F_12_103 | TTTAATTGCAGTTGCAAAC | 716 | CTGTGCTAGAGAATGACTTG | 1968 | ATGACTTGAGAGAGGTACTT | 3220 |
| 2FH21F_12_104 | AGGGACTTCAGTCAGCAAAG | 717 | CCAATGGTTAGTCAGCAAAG | 1969 | CCCCAAAACTCCCCAGTTA | 3221 |
| 2FH21F_12_105 | CCAATGGTTAGTCAGCAAAG | 718 | AGGGACTTCAGTAGGAATTTCAG | 1970 | CTGGGGAGTTTTGGGGAAA | 3222 |
| 2FH21F_12_106 | AGGGACTTCAGTAGGAATTTCAG | 719 | CTAACCAATGGTTAGTCAGC | 1971 | ATGGTTAGTCAGCAAAGAATA | 3223 |
| 2FH21F_12_107 | CACTGTATAACATAGCCTAC | 720 | CTGACTAACCATTGGTTAGG | 1972 | AACCATTGGTTAGGTGGTGG | 3224 |
| 2FH21F_12_112 | CTTATTTGGTGTGCTGTTG | 721 | AGTCCCACAGGCGCCTAC | 1973 | ACAGGCGCCTACCTGCCC | 3225 |
| 2FH21F_12_113 | AGTCCCACACAGGCGCCTACCT | 722 | CTTATTTGGTGTGCTGTTG | 1974 | AGACTAGAGAAATGGCAGGGA | 3226 |
| 2FH21F_12_114 | CTTATTTGGTGTGCTGTTG | 723 | AGTCCCAGGCGCCTACCT | 1975 | CTGCCATTTCTCTAGTCT | 3227 |

TABLE 4A-continued

| | | | | | |
|---|---|---|---|---|---|
| 2FH21F_13_005 | GAGGCACCTGCGAAAGAAAG | 724 | ATGCACACTTATGCTGACGG | 1976 | ATGCTGACGGGTGACTTTA | 3228 |
| 2FH21F_13_019 | GGTCTAAATGTCAGTGTAGC | 725 | CTCTAAACATAAACCCTGCTG | 1977 | AAACCCTGCTGCTTCCA | 3229 |
| 2FH21F_13_020 | ACATAAACCCTGCTGCTTCC | 726 | CAGTTACCTTCTAGTAGTC | 1978 | AGTGTAGCATAACAAGGGG | 3230 |
| 2FH21F_13_022 | GACCTACTAGAAGGTAACTG | 727 | GTAATTGATGTTGGGTATGC | 1979 | ATGTTGGGTATGCAATGTACCTTTT | 3231 |
| 2FH21F_13_023 | GGAAACATACGATGCTTTGC | 728 | CCCAATAAGAGTCCCTGAAG | 1980 | AACATCAATTACATTTATCTTCC | 3232 |
| 2FH21F_13_026 | AGAGGAAGAGCAAAAGCCTG | 729 | ATCCTATGTATCTTATTCC | 1981 | TCTTATTCCAATGAATAACTCT | 3233 |
| 2FH21F_13_028 | CCATTCAATGAATAGACAAG | 730 | GCTTTTCTATATTCCCCAGC | 1982 | TATTCCCCAGCATTTTGTA | 3234 |
| 2FH21F_13_031* | AGGGTTAATGACCAGGGCTC | 731 | TAGTCCCCTCCTAGCTCAACC | 1983 | TAGCTCAACCTCTAATTTGTTCTC | 3235 |
| 2FH21F_13_032* | GACAACTTCTGAGAATCAGG | 732 | TGGAGCACTGCAGAGAAGTC | 1984 | GGAGCACTGCAGAGAAGTCAAAACAC | 3236 |
| 2FH21F_13_033 | ATTCTGAATGACGAGCCCTG | 733 | CTGCAAAGGCACAGAGACT | 1985 | AGGCACAGAGACTGCAGAATC | 3237 |
| 2FH21F_13_035 | TGTTTCCCTTCCTTATCCTT | 734 | CCAGTATTTTGAAACAGAGG | 1986 | AGTATTTTGAAACAGAGTTAATT | 3238 |
| 2FH21F_13_036 | GAGTTCTAGTTTGGCAAACTT | 735 | CTTATCCTTTGGGTCTTCTC | 1987 | CCTCTGTTTCAAAATACTGG | 3239 |
| 2FH21F_13_039 | AGCCTCCAGGCCTTTCTATAC | 736 | GCCATATCCAAACCACATTG | 1988 | ATCCAAACCACATTGTAGATTCTCAAA | 3240 |
| 2FH21F_13_040 | GTCTTTGTGTTATCTCTGGC | 737 | GATCTTCCAGGCTGAAAGTG | 1989 | GGAGGAGAACACATGTTGT | 3241 |
| 2FH21F_13_041 | TTGTGTGTAGGATTATGAGC | 738 | ATGCTGATGAACCGCACTTC | 1990 | TCTCAGGTCTCAGCACTCA | 3242 |
| 2FH21F_13_042 | GGATCATTGGCAACCATAC | 739 | ATTTGTGAGGTGAAGGTGG | 1991 | GGGCCTTAATGCGATAACC | 3243 |
| 2FH21F_13_043 | CTGAATGTGGATTTGGCCAG | 740 | TGATCAGAGGGATGAGCTTG | 1992 | TTGGGATGCATGACCAGGATG | 3244 |
| 2FH21F_13_046 | TTACCAAGAGATTGGTGGAG | 741 | GTCACATCAAAATTTGGAG | 1993 | AAAATTGGAGAAGAAGTAAAA | 3245 |
| 2FH21F_13_047 | ACTCCACCAATCTCTTGGTA | 742 | AGCACTCTAAAAGGATGCAC | 1994 | AAGGATGCACACAGCTTA | 3246 |
| 2FH21F_13_048 | AGCTGTGTGCATCCTTTTAG | 743 | TGCATGACCAAGATCAGCAG | 1995 | CAGCAGCAACTTCAATG | 3247 |
| 2FH21F_13_049 | GAAGTTGCTGCTGATCTTGG | 744 | GAACCCCAACAGCATCCAAG | 1996 | CATCCAAGTCTGCTGATAAGCAC | 3248 |
| 2FH21F_13_051 | CTTCTAGGACTTGTCTATTG | 745 | GCAATTTTTCCAAGACAGGC | 1997 | TTCCAAGACAGGCTTTCTGTTGCCCA | 3249 |
| 2FH21F_13_052 | CCAAGACAGGCTTTCTGTTG | 746 | CTTTCTAGGACTTGTCTATTG | 1998 | TTGTCTATTGAGAAACAGCAGCTAC | 3250 |
| 2FH21F_13_054 | ACCATATAGCAGTTGGTAA | 747 | TAACTGTAAATTCTGAATAC | 1999 | GTAAATTCTGAATACTTAGTAGTATGG | 3251 |
| 2FH21F_13_057 | GAGATATACTTATGACATGGC | 748 | CTTGATTGCCCATGTAAATCT | 2000 | TTGATTGCCCATGTAAATCTTGAT | 3252 |
| 2FH21F_13_059 | GATATGACAAACTGTGTGAC | 749 | GCCCATGTAAATCTTGATTG | 2001 | GCCATGTCATAAGTATATCTC | 3253 |

TABLE 4A-continued

| | | | | |
|---|---|---|---|---|
| 2FH21F_13_060 | GTCACACAGTTTGTCATATC | 750 | GTGGAAAAACTGGAGTAAAC | 2002 | CTGGAGTAAACCCTGGA | 3254 |
| 2FH21F_13_062 | AATACACAAAAGATATGTAG | 751 | ACCGGGGACTGTCTTTTTC | 2003 | AGTTTGCAAGATTTGTTTC | 3255 |
| 2FH21F_13_065 | TCTTGCGGACGTTCCAGAAC | 752 | TCCAGCTGCGGAGCTCTAC | 2004 | AGCTCTACCTCCTTCTG | 3256 |
| 2FH21F_13_066 | GGGTTCATGCTGTAGCTGA | 753 | AGAACTGTACCAGCTAGAA | 2005 | CTCTCCAACCTCCTCAAG | 3257 |
| 2FH21F_13_068 | CAGATGGGTACAAGCAAGTG | 754 | AGCTTCGTGTCGTAGATGTG | 2006 | CGTGTCGTAGATGTGCCACCGGGTCC | 3258 |
| 2FH21F_13_071 | CCAAGGCCACGTTCAAGACT | 755 | GCTGCATTCTACCTCCCAAA | 2007 | TCTACCTCCCAAATTAGATAC | 3259 |
| 2FH21F_13_077* | GCTGTCATGGTTTCTTGTAA | 756 | CTTCAGCAATCAAACAAAGC | 2008 | AATGAAAAGAATCAATTAAAATGGAT | 3260 |
| 2FH21F_13_079* | CTGAAAGACTTCCATTTCTG | 757 | AGCAGAATTGATGCAACTAC | 2009 | AAAACAGAAAGGGAGACA | 3261 |
| 2FH21F_13_082* | GCTTGAATGATAGTTTAAAG | 758 | GAGAGACAACCAAGTTAGATG | 2010 | ACAACCCAAGTTAGATGGAGCTA | 3262 |
| 2FH21F_13_083* | CAACCCAAGTTAGATGAGC | 759 | CTAGCTACTTTAAAAGGAAC | 2011 | TGCTTGAATGATAGTTTAAAGAATT | 3263 |
| 2FH21F_13_084* | CTAGCTAGTTAGATGAGC | 760 | CAACCCAAGTTAGATGGAGC | 2012 | CTTTAAACTATCATTCAAGCAAAAC | 3264 |
| 2FH21F_13_088* | CTTTTCTAGAACAGAGGA | 761 | TCCTCTGCTTCATCTAACTC | 2013 | CTGCTTCATCTAACTCGTAGGG | 3265 |
| 2FH21F_13_099 | GATGAGAACCAAAAGC | 762 | ATGTTCATTCTTCTTCAACTG | 2014 | AATTTCCTTCTGACTGTATT | 3266 |
| 2FH21F_13_101* | TTTAGGGGATTCTCCTTC | 763 | CTGATGATGGGAAAGAACA | 2015 | AAGAACAAAAGACAACATCC | 3267 |
| 2FH21F_13_105 | GCTATGAGATTTCAAACCC | 764 | TTGATCCCTTTGCCAAGTTC | 2016 | TTGCCAAGTTCTTTCATTAATGTTA | 3268 |
| 2FH21F_13_107 | TGACCCATTCCCAAAATGAA | 765 | AATGGTGGGACACAGAAGAG | 2017 | GGGACATGCTTCTGGTTAGTGGA | 3269 |
| 2FH21F_13_108 | ACTGGGAGAAATTGTAGTG | 766 | CTTCTGTGTCCCACCATTAG | 2018 | ATTAGAAAATCAAAAGCTGACT | 3270 |
| 2FH21F_13_110 | CAGTACTTGACCATTGAAGC | 767 | GAGTCACATTCCAATTCAGC | 2019 | CCACCTTGCATTATTCTAA | 3271 |
| 2FH21F_13_111 | GAGTCACATTCCAATTCAGC | 768 | GTTCAGTACTTGACCATTG | 2020 | TCAGTACTTGACCATTGAAGCTTTG | 3272 |
| 2FH21F_13_112 | AGAACTTGTTATAGCAGG | 769 | CAAAAGCTTCAATGGTCAAG | 2021 | AAGCTTCAATGGTCAAGTACTGAAC | 3273 |
| 2FH21F_14_006 | GAAAAAGACCATGTACTACC | 770 | ATATAAAAGGAACTTGTGC | 2022 | AAGGAACTTGTGCCATTTT | 3274 |
| 2FH21F_14_008 | AATTATATATGACTTAAAGAC | 771 | CTCCCTTTTCATCACCAGA | 2023 | TTTTCATCACCAGAAAAGAATG | 3275 |
| 2FH21F_14_010 | GCTAGGTGCATAACTGGTAG | 772 | GCAAACCACAACTGCTTCTG | 2024 | AACTGCTTCTGAAGACCCT | 3276 |
| 2FH21F_14_011 | TGGTGATTTCAGTAGGCTTG | 773 | TCTAGCTTTTAACCTACCAG | 2025 | TAACCTACCAGTTATGCACCTAGC | 3277 |
| 2FH21F_14_012 | CTATGGTGATTTCAGTAGGC | 774 | CTACCAGTTATGCACCTAGC | 2026 | AAAAACACCATTTCCTCCGAG | 3278 |
| 2FH21F_14_013 | CTACCAGTTATGCACCTAGC | 775 | GCTTACTAAAGAACTATGGTG | 2027 | GTGATTTCAGTAGGCTTGT | 3279 |
| 2FH21F_14_015 | GTCTTCCAAAATTTTTCACC | 776 | GGCAAGGATGGAGAGTATTC | 2028 | TTTGTTTTCCAGGAGTCT | 3280 |

TABLE 4A-continued

| | | | | | |
|---|---|---|---|---|---|
| 2FH21F_14_016 | 777 | GTGCATGACAATGCTCACTG | 2029 | GAGGCCCATGGCCAATATCAACAG | 3281 |
| 2FH21F_14_017 | 778 | AAATTGTCTGGAGGCCCAT | 2030 | GGATCTCTTTCCTCACAAA | 3282 |
| 2FH21F_14_018 | 779 | GCATTCATGCTGTGCATGAC | 2031 | TGAGGAAAGAGATCCCC | 3283 |
| 2FH21F_14_026 | 780 | AGACAAGGGAGAAGTCTCAG | 2032 | GGAAGCATTTTGGGAGTTAACTAC | 3284 |
| 2FH21F_14_027 | 781 | AGACAAGGGAGAAGCATTTTGGG | 2033 | AGGATAAGTGATTCTAGGAAATG | 3285 |
| 2FH21F_14_028 | 782 | GCATTTTGGGAGTTAACTAC | 2034 | GACAAGGGAGAAGTCTCAGG | 3286 |
| 2FH21F_14_033 | 783 | TATTTCAAGAATAACTAAGG | 2035 | GGAACAGTATGTCTTCAATAAT | 3287 |
| 2FH21F_14_035 | 784 | CTTCTCAAACTAAATTATATC | 2036 | AATGTAATGAATATGTCTACAAAG | 3288 |
| 2FH21F_14_037 | 785 | TTGGTGTCCTACTTTCCTAG | 2037 | CTCTTAGCTTCCACCTTCCT | 3289 |
| 2FH21F_14_039 | 786 | GACTCATGCCCAAGTTTTG | 2038 | CAAGTTTTGGACAGAAATATG | 3290 |
| 2FH21F_14_040 | 787 | CCACATTCATATTGAGTGGA | 2039 | ATTTTGACTTTATGTTGCACC | 3291 |
| 2FH21F_15_002 | 788 | CCAGAGTTATTTTCAGAGGG | 2040 | TTAGAGGCATGGATAGGAATA | 3292 |
| 2FH21F_15_004 | 789 | GCCTCTAAAAGTCCAGCAAG | 2041 | ACATGACATCTCTCATG | 3293 |
| 2FH21F_15_005 | 790 | TGCATTTGCTCGCAAAAAGGG | 2042 | GAGGCCCTGTAGATGGATTAC | 3294 |
| 2FH21F_15_009 | 791 | TCTGCTTGCTTGCCAGTGTC | 2043 | TCCAGAGTGCACCCCAA | 3295 |
| 2FH21F_15_010 | 792 | TATCCCTGCAGGCGCATATC | 2044 | CCCACTAATTATCCACTACTAA | 3296 |
| 2FH21F_15_011 | 793 | AGATGCACACAAACCTCCTC | 2045 | CCCTGCAGGCGCATATCCATTT | 3297 |
| 2FH21F_15_015 | 794 | ATGGAAACATCCTTCTGCGG | 2046 | TTTACTCATAATTATTTCCTCTCC | 3298 |
| 2FH21F_15_016 | 795 | GATTTGTATGAACAAATGCCC | 2047 | GGAGAGAAATAAATATGAGTAAAA | 3299 |
| 2FH21F_15_017 | 796 | ATGGAAACATCCTTCTGCGG | 2048 | ACAAATGCCCATACTTTATTC | 3300 |
| 2FH21F_15_018 | 797 | AAGGGGCTGGGAAATATC | 2049 | TGAGAACAAACATTTTCACC | 3301 |
| 2FH21F_15_019 | 798 | AAGGGGCTGGGAAATATC | 2050 | CATGGGGAGGTCAAGCAG | 3302 |
| 2FH21F_15_021 | 799 | ACACAGAGGCCCAGGATGA | 2051 | ATATTTCCCAGCCCCTT | 3303 |
| 2FH21F_15_024 | 800 | ATACGGGATGGTCAACTTGG | 2052 | CATCTGCAACATAGCACATGACAG | 3304 |
| 2FH21F_15_025 | 801 | ACTGTCAGCTATACGGGATG | 2053 | AATTGGCAAAGGAGACC | 3305 |
| 2FH21F_15_026 | 802 | CAGATGATGTTCCGACACAG | 2054 | CCCGTATAGCTGACAGTGAC | 3306 |

TABLE 4A-continued

| | | | | |
|---|---|---|---|---|
| 2FH21F_15_027 | AGTTGACCATCCCGTATAGC | 803 | CAGATGATGTTCCGACACAG | 2055 | TTGTGAGGGGACGTTGACC | 3307 |
| 2FH21F_15_030 | GGACAGAGAGAGCTGAATAC | 804 | TAGAGTGGTCTGCGCAGATA | 2056 | GCAGATAAGACCACTCTACAGAAGTGA | 3308 |
| 2FH21F_15_031 | CTTGATATTCAGAATGCTGG | 805 | ATTTCTTATCTGCGCAGACC | 2057 | CTGCGCAGACCACTCTACAGATTTTT | 3309 |
| 2FH21F_15_032 | ATGATGAGAAGCTGGTGCTG | 806 | CTGTTGTGACCAGCATTCTG | 2058 | TGTGACCAGCATTCTGAATATCAAGT | 3310 |
| 2FH21F_15_033 | CTGTTGTGACCAGCATTCTG | 807 | TGAAATGATGAGAAGCTGG | 2059 | GATGAGAAGCTGGTGCTGAA | 3311 |
| 2FH21F_15_034 | TTCAGCACCAGCTTCTCAT | 808 | ACACATTGTGTAAGTTAGAG | 2060 | AGTTAGAGTGGTCAGTGAGGA | 3312 |
| 2FH21F_15_038 | TGTGCTTACTTTAATCAGGC | 809 | CAGCTGTTGGCTTACTTACC | 2061 | TTTGGCTTACTTACCTTAAATATTAC | 3313 |
| 2FH21F_15_040 | GGTATCTGTGCTGAGTCTTC | 810 | ATTAATACTGCTACGCAAG | 2062 | ACTGCTACGCAAGTTATAGT | 3314 |
| 2FH21F_15_041 | ATCACTATCAGCTCAGGCAC | 811 | GAAGACTCAGCACAGATACC | 2063 | GATACCTTCCACCAGACTAACCTAG | 3315 |
| 2FH21F_15_042 | AACTTGACACAGTGGCGTTAG | 812 | TCCTATCTTCACATGGGATG | 2064 | ACATGGGATGTGTTTTAGGTTTTGT | 3316 |
| 2FH21F_15_043 | TTCCCAGTATGAGAGACTGC | 813 | CTCCTATCCCTAACACAGC | 2065 | ACATTCGTTTGTGTCAGA | 3317 |
| 2FH21F_15_044 | GAATGTAGCTGTTGTTAGGG | 814 | CTGGGCAACTGTGAAAAGAC | 2066 | TCCCTGCTCATGTTCTTACGATCAC | 3318 |
| 2FH21F_15_045 | CAGTGGCATAAAACATCTGG | 815 | AGAGACCCAGGAGAGAACAATG | 2067 | CAGTCTCTCCAGTCCCATA | 3319 |
| 2FH21F_15_046 | CCAGATGTTTTATGCCACTG | 816 | GAAGGATCTGGAAAATAG | 2068 | GAAAATAGTATTGTCTCCAAAAC | 3320 |
| 2FH21F_15_047 | TTTTCTAGGCCCAGGTCTTG | 817 | GAGGACAATACTATTTTCCAG | 2069 | CTATTTTCCAGTATCCTTCAAA | 3321 |
| 2FH21F_15_048 | TTGTTTTCTAGGCCCAGGTC | 818 | CAAATCAGAGACCACCAG | 2070 | GAGCACCACAGTGCCCC | 3322 |
| 2FH21F_15_050 | GCTGGTCTAACAGCATAAGG | 819 | ATAAACTGGTCTGCAGTGGG | 2071 | GCAGTGGGTACAGAATTA | 3323 |
| 2FH21F_15_054 | GAGGCTCAAGGTTTGCTTTC | 820 | TAGAGTGGTGGAAGGGAAGAC | 2072 | TAACATCTAGGGAAATTTCAGGG | 3324 |
| 2FH21F_15_057 | CCTGGTCATGGAATAGTCTC | 821 | GCATCATCCCACTTACACAC | 2073 | TCCCACTTACACACAATGTTCTA | 3325 |
| 2FH21F_15_061 | AGAGTCACACAGGTAATGACCC | 822 | GCTAGTGTGACCAGGAATAT | 2074 | ATTTGAGTGTGTGTGTCTCTTTG | 3326 |
| 2FH21F_15_068 | TGAAACATGAGAGACTCAGGGC | 823 | TGTCCCAGAAATGTCATTAC | 2075 | GTATGTGAGCGCCAATAG | 3327 |
| 2FH21F_15_069 | AAGGTTTCAGGATCTGGGAG | 824 | TCAAAGTCTACCATCAGAGC | 2076 | CAGAGCTTTGGTTCCTCTTG | 3328 |
| 2FH21F_15_070 | AGGTGAGAGACTGCAGGTG | 825 | ACTTGGTCTCCTGTGATTCC | 2077 | TCCCAGATCCTGAAACCTT | 3329 |
| 2FH21F_15_074 | CCACATCCCCCTTTCAATTC | 826 | TCCTATGCCCATGCAAATG | 2078 | ATGATTTCCCCAACACAG | 3330 |
| 2FH21F_15_075 | GGACTCCTTTTGTACCACTG | 827 | CCTGTATGAAATTGAAAGGG | 2079 | AAAATTGAAAGGGATGTGGG | 3331 |
| 2FH21F_15_076 | TCACAGTGGTACAAAAGGAG | 828 | CTTGAGTGACAACATCACCC | 2080 | CACCCTAGTTCACAACACCTTAGCA | 3332 |
| 2FH21F_15_077 | GGTACAAAAGGAGTCCTCAG | 829 | GATTTCTTCTTCATGGAGCCC | 2081 | TCTTCATGGAGCCCCATTGTAG | 3333 |

| | | | | | |
|---|---|---|---|---|---|
| 2FH21F_15_079 | ACCAGGAGCGGTGACTCAAC | 830 | TTCTCCTCTTTGCTGAGCAC | 2082 | CTGAGCACAGAATTCTCACCCTCT | 3334 |
| 2FH21F_15_082 | CCATTGTGAACTTTCCTGGC | 831 | CAGCAAAGAGGAGAACTCAC | 2083 | CTCAATTTTCCCTCAAGAA | 3335 |
| 2FH21F_15_083 | ACTGGGAAAAACCTTGTGC | 832 | TGGAGAATCTCCAGCTCCAG | 2084 | GGTGGGACCCCAAAAGA | 3336 |
| 2FH21F_15_084 | TGGAGAATCTCCAGCTCCAG | 833 | GGTAGGAACTGGGAAAAAC | 2085 | GTAGGAACTGGGGAAAAACCTTGTGC | 3337 |
| 2FH21F_15_085 | AGCCAAGGAACAAATTCCCC | 834 | TGCAAAGCTGTCAGCAAGG | 2086 | TCTTCTTGAGAAGAAGAATAATG | 3338 |
| 2FH21F_15_086 | TTTGCTGACAGCTTTGCAGG | 835 | TAAGAGGGAACATCCTGGTG | 2087 | GAGTCACACAGAGAGCTCACTTGTCC | 3339 |
| 2FH21F_15_091 | TTCATGTTTCCTCCAGGGAC | 836 | GGTATTTTAGAGATGTGAGAGC | 2088 | GATGTAGAGCTAGACACAGCA | 3340 |
| 2FH21F_15_092 | TAAGGTTCCTGTCCCGAATG | 837 | AGTGGTCACTAGGATCACAG | 2089 | CTGAGGGTAACCTGGTGAATCTTCT | 3341 |
| 2FH21F_15_093 | GATTCCTGAGACTGTTCTCC | 838 | GGGTAACCTGGTGAATCTTC | 2090 | AGTCACATTCGGGACCAGGAACCTTAG | 3342 |
| 2FH21F_15_097 | CTTCCCTTTAGCATTATAAC | 839 | TGTCTGCTGTGGAAAGAAG | 2091 | CTGCTGTGAAAGAAGACATAG | 3343 |
| 2FH21F_15_101 | TAGTGAGGGCTCATCACTAC | 840 | AAGAGATGGTCTCCACTTGC | 2092 | GGTCTCCACTTGCTGTAAGCTCACACT | 3344 |
| 2FH21F_15_103 | CACAGCTTGGTGCAAATGAG | 841 | TACAAGTGATTCAACACAG | 2093 | ATTCAACACAGAGCCTG | 3345 |
| 2FH21F_15_106 | CTGTGAAGAGATTCAGGAC | 842 | CTGCCTGTATTGACCACAC | 2094 | TGTATTTGACCACCACTTTATCTT | 3346 |
| 2FH21F_15_107 | GGGAGATTTGCGACTTTTC | 843 | AACACTGAAAGTCACACC | 2095 | CTCACACCCAGACTCAG | 3347 |
| 2FH21F_15_119 | TCTCCCCCTCCCGGGCTAA | 844 | TAGGGCGCTGGAGAGCGGG | 2096 | GCTGGAGAGCGGGGATCCTCTGT | 3348 |
| 2FH21F_15_126 | TACCAAATATTCAAGTGAG | 845 | GTGGCATTTTATCTTGCAAAC | 2097 | ATCTTGCAAACATTTGCCACA | 3349 |
| 2FH21F_15_128 | GGGCCAGAAGTTCTCGAGC | 846 | AGGAGCCTTCAGATTCTGTG | 2098 | TGTGGATTCTCTGTACC | 3350 |
| 2FH21F_15_130 | CACATGCTGTCAGCTAATT | 847 | TTCTCCTCGAATAAGACCCC | 2099 | AAAGGCTGAGGAATCTGT | 3351 |
| 2FH21F_15_134 | GGGTCTTATTCCAGGAGAA | 848 | GCTCTGCACTGAAGCTACTG | 2100 | GTTATTGTGGCATAAATTAAATAAG | 3352 |
| 2FH21F_15_135 | TTTACTTGCAGGCAGTTTTC | 849 | ACAGTAGCTTCAGTGCAGAG | 2101 | CTGCAGCTTCAAGCTTTAC | 3353 |
| 2FH21F_15_137 | TCTCCAGTATCTCAGTTCCC | 850 | AAGTATCATTCCCCCTCACC | 2102 | CCCCTCACCTTGCTATT | 3354 |
| 2FH21F_15_139 | TTCTTCTGTCACACTGTAA | 851 | AGTGGGAACTGAGATACTGG | 2103 | CTGAGATACTGAGAAAGT | 3355 |
| 2FH21F_15_142 | TGTGACCACCTGCCAGTC | 852 | TGGCATGCTGAGAAACTCAC | 2104 | GTTTGTGGTCTTTTTGTGAATAA | 3356 |
| 2FH21F_15_144 | CAAGTACTGTGTGCAGGATG | 853 | TTCTTCCCAGCATAGGGTTG | 2105 | GCATAGGGTTGAAAAATTGCTTA | 3357 |
| 2FH21F_15_146 | AATTATTGAATCTGGTTGG | 854 | GTCTGAAGTATTGCAAAGC | 2106 | AGCAGTATGAAAAGACATTAT | 3358 |
| 2FH21F_15_147 | CATTAATGTTCAGATTCCAT | 855 | GTCTTTTCATACTGCTTTGC | 2107 | TACTGCTTTGCAATACTTCAGAC | 3359 |

TABLE 4A-continued

| | | | | | |
|---|---|---|---|---|---|
| 2FH21F_15_148 | ACTTGTATGGAATCTGAAC | 856 | AGTTGTAATTCAAGAGTG | 2108 | GTAATTCAAGAGTGTACTATCTTA | 3360 |
| 2FH21F_15_149 | CACTCAATATGACCTCCTTC | 857 | CACCTTAATTGCAAAAGTGG | 2109 | AAAAGTGGAGCTTGGGT | 3361 |
| 2FH21F_15_150 | TTGCAAAAGTGGAGCTTGGG | 858 | TTTTACACTCAATATGACC | 2110 | CTCAATATGACCTCCTTCT | 3362 |
| 2FH21F_15_151 | AGAGCTCCTGGTGGGACAG | 859 | CACTTTGCTGTTGAAATTC | 2111 | CAAGCAGTGGCTCTTCT | 3363 |
| 2FH21F_15_152 | CACTTTGCTGTTGAAATTC | 860 | TCCTGGTGGGACAGGGACT | 2112 | AGAGCCACTGCTTGGAGAG | 3364 |
| 2FH21F_15_153 | AAGAGCCACTGCTTGGAGAG | 861 | TTAAATGTGTGGATATGTC | 2113 | TTTGCTGTTGAAATTCATTTA | 3365 |
| 2FH21F_15_156 | GAATTGTGTGGAGGACCCTT | 862 | TGATGTAGGGCATCTCTAGG | 2114 | CCCCTAATCCAGACTCATGGGTCTC | 3366 |
| 2FH21F_15_157 | TTGTGATGATGTAACAAGG | 863 | AATCCAGACTCATGGGTCTC | 2115 | AAGGGTCCTCCACCAATTC | 3367 |
| 2FH21F_15_160 | CAGTATGCAATTATGACAC | 864 | CTTGTTAAAGAACACTGTC | 2116 | GCACTGTCCAACATTAAATATAC | 3368 |
| 2FH21F_15_165 | GCTTGACTGGTCTGTCTTAC | 865 | ATTTCAAAGCTAGTAACAG | 2117 | AAAGCTAGTAACAGAGAGATT | 3369 |
| 2FH21F_15_170 | CAAGTAATTTCAAACTTGAC | 866 | TGCTGCTTGCAGTGCCTA | 2118 | GCTGCTTGCAGTGCCTACCAAGT | 3370 |
| 2FH21F_15_175 | CTCTAGAGGAGTCATAAGCC | 867 | CCAGCAATGACATGATTACC | 2119 | CCCCAAAATGTTCTGAAACCCTGC | 3371 |
| 2FH21F_15_178 | TGGAAGTCATTCTTGAAGTG | 868 | CATTAAACATAAAGAGAGC | 2120 | TTAACATAAAGAGAGCTGAAACC | 3372 |
| 2FH21F_15_180 | TCATAGACACTGCCCTACTAC | 869 | GAATTCTTATATGAGAGAC | 2121 | AGAGGACCTCATGGACA | 3373 |
| 2FH21F_15_182 | GTAGTAGGGCAGTGCTATGA | 870 | GGACAATTAATCTATTCCCC | 2122 | TCCCCATCTCATTTAAATAAC | 3374 |
| 2FH21F_15_191 | TCAAACACTTTCACAATGT | 871 | TCCTTACTGATCCCCAGAG | 2123 | CCTTACTGATCCCCAGAGTGTCAAA | 3375 |
| 2FH21F_15_193 | GAGCTTGATCCTGATTCTTC | 872 | TCAAGTAGTGTCTCCCTT | 2124 | CAAGTAGTGTCTCCCTTTCATTC | 3376 |
| 2FH21F_15_195 | CCCTACGACCTGTCAGAAA | 873 | CCTGAAGAATCAGGATCAAG | 2125 | ATCAGGATCAAGCTCTCAAAAT | 3377 |
| 2FH21F_15_196 | CAGGATCAAGCTCTCAAAAT | 874 | GATAGGATGAGCAACCAAAA | 2126 | CCCTACGACCTGTCAGAAA | 3378 |
| 2FH21F_15_193 | TTTCTGACAGTCGTAGGG | 875 | GGACATCATGATAGGATGAG | 2127 | TAGGATGAGCAACCAAAA | 3379 |
| 2FH21F_15_200 | GCTCATCCTATCATGATGTC | 876 | AGTCTATCTGGTAGATAGTGG | 2128 | CTATCTGGTAGATAGTGGAATTTGC | 3380 |
| 2FH21F_15_209 | CTTTCTGTCTCTGGGCCATT | 877 | CTTTCTGTCTCTGGGCCATT | 2129 | GTCTGGGCCATTTTTTGCTA | 3381 |
| 2FH21F_15_210 | ACAGACAGACCACCTGTGG | 878 | ACAGACAGACCACCTGTGG | 2130 | ACAGACAGAGCACCTGTGGGAGGAC | 3382 |
| 2FH21F_15_211 | GTGTGTCTGGGCCATTTTTTGCTA | 879 | CAGAAAAGACTCTTCTGCAG | 2131 | AAGACTCTTCTTGCAGTTTACA | 3383 |
| 2FH21F_15_212 | ATTGCTTATATGTGGAAGCC | 880 | GAGTCCCTGGTATAGCCAC | 2132 | GTATAGCCACCGTCATATTC | 3384 |
| 2FH21F_15_214 | TCTTTCAGTGCTTGGAAATC | 881 | CCAATGAATCTCCCTTAAAG | 2133 | TGAATCTCCCTTAAAGTACTTA | 3385 |
| 2FH21F_15_217 | CTCCGAAAAGCCTTGAACTG | 882 | GTCAATCTTATTCTGACTAC | 2134 | AATCTTTATTCTGACTACATTCCAAT | 3386 |

| | | | | |
|---|---|---|---|---|
| 2FH21F_15_218 | AAGGGATGTGAAGATGAC | 883 | TATCACCATTTCCTTTAG | 2135 | CATCATTGGGTTACCAAAA | 3387 |
| 2FH21F_15_219 | CATCATTGGGTTACCAAAA | 884 | GGAGTATGAAGGGAATGTGG | 2136 | AAGATGACATGATGATCACTTTCCAG | 3388 |
| 2FH21F_15_220 | TTCCTGTAGACAACCATGGG | 885 | CTGATTGGCATAGTACTGGG | 2137 | GGCTATTTACAATAACTGTATACTGG | 3389 |
| 2FH21F_15_221 | GGATTGAAGATTTCCTCCAC | 886 | GGAATTTGAAGGAGAACAAGG | 2138 | AGGGAGGTGTTTCCAAA | 3390 |
| 2FH21F_15_222 | TATGTGGAATTTGAAGGAG | 887 | GGATTGAAGATTCCTCCAC | 2139 | TTTGGAAACACCTCCCTCA | 3391 |
| 2FH21F_15_223 | CTATGGAAAATCCTGCAGAC | 888 | TTTGGAAACACCTCCCTCA | 2140 | TCTCCTTCAAATTCCACATA | 3392 |
| 2FH21F_15_228 | GGTGTTAAAACCCTGGATTG | 889 | CAGTGGTTCATTAATAAACTC | 2141 | AACTCTTCAAAAGGGATAAG | 3393 |
| 2FH21F_15_231 | ATGAAGAGCCCATCCCTGAG | 890 | TTTCCAGGGGTCCACTC | 2142 | GACCTTTCTTGTTTCTCT | 3394 |
| 2FH21F_15_234 | GCTTCGAAGTGCTTGAAAATG | 891 | CTCAGGGATGGGCTCTTCAT | 2143 | GATGGGCTCTTCATCATCTTC | 3395 |
| 2FH21F_15_236 | TGATTTGTCCACTTCCC | 892 | ATGCCATTGTGCTTCCG | 2144 | CTTCGAAGTGCTTGAAATG | 3396 |
| 2FH21F_15_237 | CTGGTCTGCATTGTATTTAG | 893 | AGCAAGTACCCCTTGCAG | 2145 | CTTGCAGCCAAGGAAA | 3397 |
| 2FH21F_15_233 | TCTCCACAGTCCTGAATATC | 894 | TTTCCTTGGGCTGCAAGGG | 2146 | CTGCAAGGGGTAGCTTGCTCAT | 3398 |
| 2FH21F_15_239 | GAACAAATTCAGATAATTAGG | 895 | GTCACCTAACGTGGAATGTG | 2147 | CGTGGAATGTGACTTGA | 3399 |
| 2FH21F_15_241 | GAGAGCAATCTGTGTAGAC | 896 | TTAGGCCCTGATGATGTGTC | 2148 | CTGATGATGTGTCCTGATA | 3400 |
| 2FH21F_15_242 | CATGTTCTGCTGCTATG | 897 | ATTGTTGTCTCCCTGTGAGC | 2149 | TGTCTCCCTGTGAGCTATCACCT | 3401 |
| 2FH21F_15_243 | ATTGTTGTCTCCCTGTGAGC | 898 | CATGTTCTGCTGCTATG | 2150 | GAAGACTCAGAGAAGCATCTTCCTCAAG | 3402 |
| 2FH21F_15_244 | ACACACCAAGGAAGAACTG | 899 | TTCCATAGCAGCAGCAGAAC | 2151 | AGCAGAACATGCAGCTTTT | 3403 |
| 2FH21F_15_247 | GCACTAGAAAAACTCTTCC | 900 | AACAGAAGAAGGTATAT | 2152 | CAGAAGAGAAGGTATATGAAATT | 3404 |
| 2FH21F_15_248 | GCAGAGGATGCTATTATGG | 901 | TGTGATCTTCAGGTCCTGC | 2153 | GGTCCTGCCAGTGCCTGA | 3405 |
| 2FH21F_16_004 | GTATTCAAAAGCCACCCCTG | 902 | AAAGGGCCAGGAGCTGAGAC | 2154 | CAAGGAGCATGCCAAGT | 3406 |
| 2FH21F_16_005 | AAAGGGCCAGGAGCTGAGAC | 903 | GTATTCAAAAGCCACCCCT | 2155 | AAGCCACCCCTGCAGTA | 3407 |
| 2FH21F_16_006 | CACAAATACTTATCACTCT | 904 | GTTTTCTTGCTTTTTGTCAG | 2156 | GCTTTTGTCAGTTTCAAATA | 3408 |
| 2FH21F_16_010 | AGCAGACTTGCTCCAAGACA | 905 | CGAGTCCTTTTGTCTTGCAC | 2157 | TTTTGTCTTGCACTATCAAAATA | 3409 |
| 2FH21F_16_011 | TTCCTGCACAAGTGGCTATG | 906 | CTAGTCTGTTTACCAAACA | 2158 | TTTACCAAACAGAACCAC | 3410 |
| 2FH21F_16_012 | GGTTTACCAAACAGAACCAC | 907 | TAGGCTTCCTGCACAAGTGG | 2159 | AGGCTTCCTGCACAAGTGGCTATGTT | 3411 |
| 2FH21F_16_014 | CACTTGTGCAGGAAGCCTAA | 908 | GAATATTAAGGAGGCTGTAA | 2160 | CCTTAAGTTTTAAAAGTTAGGAA | 3412 |

TABLE 4A-continued

| | | | | |
|---|---|---|---|---|
| 2FH21F_16_015 | CTTTTTAAAACTTAAGGATAAG | 909 | GACCACAACAAAGTCTGCAA | 2161 | AAGAATATTAAGGAGCTGTAAA | 3413 |
| 2FH21F_16_016 | AAATAACCAGCAGTACCAG | 910 | AAGTTCAGGTTTGGCTCCTC | 2162 | GGCTCCTCCCTCATTTA | 3414 |
| 2FH21F_16_018 | CTTGAAGAAAGAAGTTGGTG | 911 | TTGCTCCACTTCCACTGAC | 2163 | TTCCACTGACTGGAATC | 3415 |
| 2FH21F_16_019 | TTGCTCCACTTCCACTGAC | 912 | CTTGAAGAAAGAAGTTGGTG | 2164 | AGCACATTACAGAGATGAG | 3416 |
| 2FH21F_16_021 | ATCAGCAGCCCTCTGGAAGT | 913 | CTCATCTCTGTAGATGCCT | 2165 | CACCAACTTCTTTCTTCAAG | 3417 |
| 2FH21F_16_022 | CTCATCTCTGTAGATGCCT | 914 | ATCAGCAGCCCTCTGGAAGT | 2166 | CTCTGGAAGTGAGGAGA | 3418 |
| 2FH21F_16_023 | TTCCCGCCGCCAGGCTGAG | 915 | GGAGAAACGTTCTCTTTCC | 2167 | ACGTTCTCTTTCCTCTCAG | 3419 |
| 2FH21F_16_024 | CATGCCAGAGCAAACTGTAG | 916 | CAACCCACTTCAGTGCCAG | 2168 | ACCCACTTCAGTGCCAGCAGCCTAC | 3420 |
| 2FH21F_16_025 | GGGTTTGGATTTATGATGGG | 917 | TACAGTTTGCTCTGGCATGG | 2169 | TGGCATGGGGTACTATGAGAGG | 3421 |
| 2FH21F_17_004 | CTGAACTGGGCACCAAGAGA | 918 | TTCCAGAGATCAGGAGTTG | 2170 | GGAGTTGTAGGTATTATACATT | 3422 |
| 2FH21F_17_006 | TGCCTTTCCTGAGTACCCTC | 919 | TGAGCAGGCTTGATTCTCAC | 2171 | GCTTGATTCTCACACACATA | 3423 |
| 2FH21F_17_008 | TGAGCAGGCTTGATTCTCAC | 920 | GCTGCCTTTCCTGAGTACC | 2172 | CTGCCTTTCCTGAGTACCCTCCGA | 3424 |
| 2FH21F_17_009 | TGCTGATTCTGCTGATGGG | 921 | TCGGAGGGTACTCAGGAAA | 2173 | TCGGAGGGTACTCAGGAAAGGCAGC | 3425 |
| 2FH21F_17_010 | TTCCGTCAGCCCCACAACC | 922 | ACACACACTTGTCCATCCAG | 2174 | ACTTGTCCATCCAGTCCTTGTG | 3426 |
| 2FH21F_17_011 | ACACACACTTGTCCATCCAG | 923 | GCCAATTCCGTCAGCCC | 2175 | TCCGTCAGCCCCACACC | 3427 |
| 2FH21F_17_012 | TTATTTCCTTGATATCCAC | 924 | GTCATTGTAGAACTTTTCACC | 2176 | TGTTGAAGTTATACCCTGAA | 3428 |
| 2FH21F_17_014 | CAGGTGAAAAGTTCTACAATG | 925 | GTTGTATGGAAATTATAGTTC | 2177 | TGTATGGAAATTATAGTTCAATTATT | 3429 |
| 2FH21F_17_015 | GTTGATATATTATTTATCAGG | 926 | AATAATTGAACTATAAATTCC | 2178 | AATTGAACTATAAATTCCATACAACA | 3430 |
| 2FH21F_17_020 | CACAATCAAGTTCAACTTGTA | 927 | TTTTACTAACCTCCCCGTTTG | 2179 | TAACCTCCCCGTTTGATATTAAAAA | 3431 |
| 2FH21F_17_021 | ACCATCTGAGGGTGTTACTG | 928 | GTGCAAAGGGCTTAGTGATG | 2180 | CTTAGTGATGCATCTTATTCTTTA | 3432 |
| 2FH21F_17_022 | AGCACTTCAAAACAGAAGGG | 929 | ACAGTAACACCCTCAGATGG | 2181 | GGTATTTTTATTGTTTGTTTTATAT | 3433 |
| 2FH21F_17_023 | AGAAAAGTTCCTTTCAAAT | 930 | AGTTCTTTGCCTCCATTTTC | 2182 | AACCCAATTCCTCTTTAG | 3434 |
| 2FH21F_18_002 | AGATATTGCCAGCCACCTAC | 931 | TAAGAGAGCTACAGGTGGTG | 2183 | AGGTGGTGGTGTCAGTAATGG | 3435 |
| 2FH21F_18_005 | GAGGGCCACATTTCACTATG | 932 | CCCTTTAAGGGGAAATGATT | 2184 | GGGAAATGATTAGGAAATAGAAACTTC | 3436 |
| 2FH21F_18_006 | TTAGGGTAATGTGAGAGAG | 933 | TTAGAAAAGAGACTAAATTC | 2185 | ATTTTACATAGTCCTTAAAATTTGT | 3437 |
| 2FH21F_18_007 | TTAGAAAAGAGACTAAATTC | 934 | TTAGGGTAATGTGAGAGAG | 2186 | TAAGAGTGAAGCGAAAATC | 3438 |
| 2FH21F_18_019 | TAGACGTTTTAGGAATTTG | 935 | TTCGGATGAAGATAGTGGGC | 2187 | AGAATGAGGGATCTATTAGCAAAAA | 3439 |

TABLE 4A-continued

| | | | | | |
|---|---|---|---|---|---|
| 2FH21F_18_020 | GACCAAAGTGTATACATAG | 936 | TCCCTCTCTCCCTGAAAAAG | 2188 | TGAAAAAGAGACACATTGCCTTTG | 3440 |
| 2FH21F_18_021 | GTGTAGTAAGCGGGATGAG | 937 | GGGATGATTCTTAAAAGG | 2189 | AAAAGGGATTCTGGAAGTGG | 3441 |
| 2FH21F_18_023 | CAATAAGGTGGTATTCTCTCC | 938 | AGTGGGGCACATGTATTTTG | 2190 | TGGGGCACATGTATTTTGTAGATT | 3442 |
| 2FH21F_18_031 | GTGTGAGGCTTCACTAAGG | 939 | AGCCTCTATTGATGCCTCAG | 2191 | GCCTCAGAGAGTGAGAA | 3443 |
| 2FH21F_18_035 | GCTGCTTGTTAGTGAATTTAC | 940 | GTGTCTAGTAAGACAGTACC | 2192 | ACCAATTTGGCAGAAAGATT | 3444 |
| 2FH21F_18_042 | GAAAGTTAACAAAAGCAAGG | 941 | CCATAATTGAATACCTCCTC | 2193 | ATAATTGAATACCTCCTCATTTTCTC | 3445 |
| 2FH21F_18_044 | AGGAGTCTCTGGAGCAGAAA | 942 | CTAATTGCTGTCGAAGCCAC | 2194 | ACCTATTTTTGCTTTCTAGTT | 3446 |
| 2FH21F_18_045 | CAAGAACTTGCTTTCCACAG | 943 | GTTGATGGAGCACCTCATTG | 2195 | ATCAACATTCATTATTCCTTGCAAA | 3447 |
| 2FH21F_18_046 | TTTATTTTCCTTCACCTGG | 944 | TGCCATGCTAAAACTGGAAG | 2196 | AGTAGCCACACTGAAAC | 3448 |
| 2FH21F_18_047 | ACTAAGGCTCTTAGTATGGG | 945 | TAAAAGATTAATCAATTTGAC | 2197 | AAGATTAATCAATTGACTACATAC | 3449 |
| 2FH21F_18_048 | TATATGTAGCACTAAGGCTC | 946 | TGGGTTTACACTCTGATGTC | 2198 | TTACACTCTGATGTCTAACCTATACAA | 3450 |
| 2FH21F_18_050* | CTTTACCACTTTGTTTTG | 947 | GGACTTCTCCACCAAATCTC | 2199 | CAGTTAATTCTACTGGGTAAATA | 3451 |
| 2FH21F_18_051* | GGACTTCTCTCCACCACTTTG | 948 | ATCTTCTTTACCACTTTG | 2200 | ATCTTCTTTACCACTTTGTTTTGA | 3452 |
| 2FH21F_18_054 | TGTCATTTGAAGAGAGTTAC | 949 | ATAAAATTCCTATATTCCTG | 2201 | TCCTATATTCCTGAATTTTTTTT | 3453 |
| 2FH21F_18_055 | CCTATATTCCTGAATTTTTT | 950 | TTTTCTCACTATTTTTCAAG | 2202 | TGTCATTTGGAAGAGGTTAC | 3454 |
| 2FH21F_18_059 | ATATTTCAAGTATCACTATG | 951 | GCTTAATGGTCCATAGTTC | 2203 | ACAGTTTCACTTTTATTAAAGTAGA | 3455 |
| 2FH21F_18_060 | ATTATTCCTATGCATGCTT | 952 | AGCAGTTGAAAACAAAATC | 2204 | AACAAATTCTACATATATCTATGACC | 3456 |
| 2FH21F_18_061 | CTACATATTATCTATGACC | 953 | GTAAACATTGTCTAAACTGG | 2205 | TATTATTCCTATGCATGCTAAAA | 3457 |
| 2FH21F_18_063 | GTAGCTTTAATTCAGGTG | 954 | TAAGTCATACAGACATTCCC | 2206 | CAAAACATTACAGTATGAGGAC | 3458 |
| 2FH21F_18_065* | TTGGGAGATGAGACTATTA | 955 | GGAGAATAAACAAACATTG | 2207 | AAACATTGAGAGCAGGT | 3459 |
| 2FH21F_18_066 | CAGCCACAAATGAATCCAG | 956 | CATACCGAAAGAAAACCCCC | 2208 | GCTGAGAAAAGGACTTAG | 3460 |
| 2FH21F_18_067 | AGGAGCAAATTATGACCAG | 957 | GATATAAATTATTCCAGTGT | 2209 | AGTGTATTTCACTGAATATATGG | 3461 |
| 2FH21F_18_068* | TTTGCATGAGTGAATCAAG | 958 | TGTTTCCATATCCTTGCAG | 2210 | TATGCCTACATTGCTGTATC | 3462 |
| 2FH21F_18_070 | GAGATATTGAATCTAAGAGC | 959 | TATGGTAAGTGTCTAATAG | 2211 | ACCAAAAACAATTGCTTCATTAAA | 3463 |
| 2FH21F_18_071* | AGATTGTGGGTACTCCAGAG | 960 | AGTCACCATGGTTACTCC | 2212 | TCCAATTCTAGTAATCCTCC | 3464 |
| 2FH21F_18_072 | ATAGCCAGCAGCCAACTTTGGAG | 961 | CCCACAATCTAATCTTCTGG | 2213 | TGAATTCACTCAAATTTCCTTT | 3465 |

TABLE 4A-continued

| | | | | |
|---|---|---|---|---|
| 2FH21F_18_074 | AAGTGTGAAAACTTCTCGTC | 962 | CTGCAGTATGTGAATATAAGC | 2214 | CAGTATGTGAATATAAGCATATTT | 3466 |
| 2FH21F_18_076 | CCTTTTAAAATATGCACGAG | 963 | GACTAGGTTACTGAGCAAGG | 2215 | GTTACTGAGCAAGGAAAATAA | 3467 |
| 2FH21F_18_078 | TGCTGCAGTAGTAGGAAGAG | 964 | CTCTTAAGGAACATTCTCTG | 2216 | TTTTAAAGAAAAAGTTACAGTAATTT | 3468 |
| 2FH21F_18_083* | AGTGCTTGAGCATTTCATGG | 965 | ACTCTGTCATCTGGTTCCC | 2217 | TGTTTCCCCATCCTAGTAAATAA | 3469 |
| 2FH21F_18_086* | GAATCATAACGTAAGGAAGA | 966 | TATAAAATATCCCCATTGC | 2218 | TATCCCCATTGCAAGAGATA | 3470 |
| 2FH21F_18_090* | CTCCTTTCTTTCACGACTG | 967 | CGGAAGAAACAAACAAGAGC | 2219 | CGGAAGAAACAAACAAGAGCCATGAT | 3471 |
| 2FH21F_18_094 | GTGGCTATGAAAGACAGCCT | 968 | AGCTCCCGTTTGATTTCAGG | 2220 | ATTTCAGGCTTCATAGTTTG | 3472 |
| 2FH21F_18_101 | GACTCTCTTCATGATGACTC | 969 | GAAGTAAGACATACACTTTA | 2221 | AAGTAAGACATACACTTAAACAAA | 3473 |
| 2FH21F_18_103 | AGCAACATAACGCTTTCTCC | 970 | CTTTTCATGGGAGAAATGTGG | 2222 | ATGTGGAAGAAGAGTAATTGGATAA | 3474 |
| 2FH21F_18_117 | GCTATGATGCATTTGCCAAT | 971 | AGCACTGCAGGTCCAAATG | 2223 | AGATTTTTAGATGCCTTCTTC | 3475 |
| 2FH21F_18_120 | AATGTCTCTTTCCTCTGCTG | 972 | ATGCATTCATCAAGCAACT | 2224 | GCATTCATCAAGCAACTGGAGAT | 3476 |
| 2FH21F_18_122 | TAGCATAACAAGTTGGTGAG | 973 | AGTGAACTATGATAGGAGC | 2225 | AAGCTAATTGGCACATTT | 3477 |
| 2FH21F_18_123 | CCTCTTTTCTTCATAGTTAGG | 974 | GAGCTGGATCCATCCATCAC | 2226 | TCACCAGGAATCTTTACTA | 3478 |
| 2FH21F_18_126 | TTGTGACATGATAAAGCTGG | 975 | GTCTGAAAACTGTCATTC | 2227 | CTGTCATTCAGCGACTA | 3479 |
| 2FH21F_18_127 | AAAACTGTCATTCAGCGACT | 976 | TTGTGACATGATAAAGCTGG | 2228 | AGCTGGATATTGAAAACCAAAA | 3480 |
| 2FH21F_18_132 | CAGTAGTAAGTATGAACATGA | 977 | TATACCTTAGAATAGTCAG | 2229 | ATACCTTAGAATAGTCAGAAGTCAG | 3481 |
| 2FH21F_18_133 | GGTCTAGAGAACTCTGAAAG | 978 | TGCAATTCACTTGGACACGG | 2230 | TCACTTGGACACGGCCTAAC | 3482 |
| 2FH21F_18_136 | AGGAAGTTGCACTCTGTTGG | 979 | ATATACACACCCTTCCCTGC | 2231 | GCACATTTGACTTTCTGTACAACA | 3483 |
| 2FH21F_18_137 | TGCAACTAAGAGACATCAGC | 980 | AGTCAAATGTGCAGGGAAGG | 2232 | AGTAGCCAGAGGGCAGCCAGG | 3484 |
| 2FH21F_18_138 | AGCTGATGTCTCTTAGTTGC | 981 | TGGTAGAGACTCACGCAAAG | 2233 | AGCTTCACCAGAAACCCAGAGG | 3485 |
| 2FH21F_18_139* | AGTCTCTACCACAAGAACAC | 982 | ATTAGGGTGCAGACAAGGAG | 2234 | CTTCTCTAGCCTATTGTCTCC | 3486 |
| 2FH21F_18_141 | TAGTGAAGCTGTCGGTAGTG | 983 | ATTCAGCCTGGTGAATGAAG | 2235 | GCCCTCCAATAACAAGA | 3487 |
| 2FH21F_18_142 | ATTCAGCCTGGTGAATGAAG | 984 | TAGTGAAGCTGTCGGTAGTG | 2236 | GTCAGAGACATTGTCAACCAGACAC | 3488 |
| 2FH21F_18_143* | CAATGTCTCTGACACTACCG | 985 | TGACTTTGGAGGTGGGATAC | 2237 | TGACTTTGGAGGTGGGATACTGTGTG | 3489 |
| 2FH21F_18_144* | CAGATGCCATTAGATGTGTC | 986 | TGCTCCTCCTAAACCTTCTC | 2238 | CCTAAACCTTCTCCATCTTGCTC | 3490 |
| 2FH21F_18_145 | CTGTTACCACCTTGCCTGC | 987 | GCAAGATGAGAAGGTTTAGG | 2239 | AGAAGGTTTAGGAGGAGCA | 3491 |
| 2FH21F_18_149 | TGGTGGCACTAGTACAAAG | 988 | TTCATAGAACCATGCCACCC | 2240 | AGAACCATGCCACCCAGATATTCTC | 3492 |

TABLE 4A-continued

| | | | | | |
|---|---|---|---|---|---|
| 2FH21F_18_151 | GTTTATTGCACCATCTACA | 989 | GAAGCAATTTCAAGCTAACAG | 2241 | AGCAATTTCAAGCTAACAGAAAGAC | 3493 |
| 2FH21F_18_153 | TCCATGTGCCAGTAAACAC | 990 | CAAGCTTTTCTCTTGTAGTC | 2242 | TAGTCTATCTTACAGTACTTCCA | 3494 |
| 2FH21F_18_154 | TAAATGAGCAGAGACTCAAG | 991 | TTAGATTGTTATCCCCACT | 2243 | TTGTTATCCCCACTTCTTTAA | 3495 |
| 2FH21F_18_156 | AGGACTGTGTAAGAGAAGGG | 992 | GTTCTTCGTAAATCAAACCC | 2244 | CGTAAATCAAACCCTTTGTCATTT | 3496 |
| 2FH21F_18_158 | CGTCCTTTGACACATTTTAG | 993 | GAAACACTTCAGTTTCTTG | 2245 | CTTCAGTTTCTTGAAATGTTT | 3497 |
| 2FH21F_18_159 | CCAAACATTATAATCTGAC | 994 | GTGTTTCTTTTTCACCTGC | 2246 | TCTTATTATATCTGGATTTAACATTT | 3498 |
| 2FH21F_18_160 | AACCAGTACAGATTAGTTGC | 995 | AATGATTCTGACTGGTTTCC | 2247 | TGATTCTGACTGGTTTCCTACATATA | 3499 |
| 2FH21F_18_161 | GATTCTGACTGGTTTCCTAC | 996 | AACCAGTACAGATTAGTTGC | 2248 | TGCAAATAATTAGAAAGTAAAGG | 3500 |
| 2FH21F_18_162* | TCTCATGAAAAGCAGCAG | 997 | GCATGCTTCTAGTGGTTTAC | 2249 | TTACTATTAGACAATAATGGGTTGGC | 3501 |
| 2FH21F_18_171 | GGGAAGATCTTAAAGGGAGC | 998 | TTCCTGATGATAATCTTCCC | 2250 | TATAGCCAATAAATTACTCTTATTTTA | 3502 |
| 2FH21F_18_172 | TTCTGCAAATTACCATTTC | 999 | TCTATGCCTAAAATAAGTG | 2251 | CTATGGGTCAGTTGGAG | 3503 |
| 2FH21F_18_173 | TCTATGCCTAAAATAAGTG | 1000 | TTCTGCAAATTACCATTTC | 2252 | TCCAACTGACCCATAGA | 3504 |
| 2FH21F_18_174 | GATTCTCTGCAAAGAATACC | 1001 | GGGAACTGTTAAGAAACTC | 2253 | AAGGAAGTGAATGGATCTAC | 3505 |
| 2FH21F_18_175 | CAGGAGTATGCATTTTCCTC | 1002 | GTCACACAGAGTTCGTGAG | 2254 | AGCACCACTAAATACTTTCA | 3506 |
| 2FH21F_18_176 | ACACCACATTTCTACCACTG | 1003 | AACGGCCAGGGTGGACACT | 2255 | GGCCAGGGTGGACACTGTTACT | 3507 |
| 2FH21F_18_178 | TCTGTGACACAGAGCATGAG | 1004 | GCATCAGGACAAACTGATGG | 2256 | TAAGCAGCCTAGTTTTCCTC | 3508 |
| 2FH21F_18_186 | CAGAGCTGATTGTTCCAGT | 1005 | ACCCAGTCTTCCTGAGTATG | 2257 | CTTGTGGGCGATGTCTA | 3509 |
| 2FH21F_18_188 | AACTCCAGGGCTACTTGAAC | 1006 | GTGCTATAAAGCTTTAACAAG | 2258 | TAAAGCTTTAACAAGTTGGCGA | 3510 |
| 2FH21F_18_190 | AAAGCTTTAACAAGTTGGCG | 1007 | AAGAACTCCAGGGCTACTTG | 2259 | ACTCCAGGGCTACTTGAACAATT | 3511 |
| 2FH21F_18_191 | TGATACAGAAATGTCAACCC | 1008 | GATGCTTCTAAGGACCATGT | 2260 | GGACCATGTCTAATTTCTTTAATTC | 3512 |
| 2FH21F_18_194 | TGTGACAAATTCTATGGC | 1009 | TGCACAGTTGAAAAGTAACC | 2261 | AAAGCATTTAAAAAAAGATTAGGAG | 3513 |
| 2FH21F_18_195 | TGCACAGTTGAAAAGTAACC | 1010 | CAAATTCTATGGCATCTTTC | 2262 | AATGCTTTTGTTTGGTATTGATAA | 3514 |
| 2FH21F_18_197 | GCCTAACATATTGTATGCAC | 1011 | GCCTAACATATTGTATGCAC | 2263 | ACTAAGCAAGTACTAGTAAAATTATT | 3515 |
| 2FH21F_18_198 | GCCATTTGAAGAATGGTATG | 1012 | GCCATTTGAAGAATGGTATG | 2264 | TTGAAGAATGGTATGAAGATGATAA | 3516 |
| 2FH21F_18_199 | AGTCTGTCTATTTGTAGGATG | 1013 | GTACCTTATTTTCCTCACAC | 2265 | ACACAAAAATGTAAACATTAAGGA | 3517 |
| 2FH21F_18_200 | GATTCATCCACAATAGAC | 1014 | GAGAGTGAGTGAGACTTCAG | 2266 | CAGCCCCAATCAATGAATGACCC | 3518 |

TABLE 4A-continued

| | | | | |
|---|---|---|---|---|
| 2FH21F_18_201 | GTGTAGTAGATTTTCTAGGC | 1015 | TGATTGGGCTGAAGTCTCAC | 2267 | ACTCTCTATTATTTCTAATTTTTCA | 3519 |
| 2FH21F_18_202 | TCTTATCACCTATGTTCTGG | 1016 | ATTCAGCAGGCAATGGAGAG | 2268 | CAGAAAAGCTTAAGCAAAATGAGCA | 3520 |
| 2FH21F_18_203 | CCAGAACATAGTGATAAGAC | 1017 | GCCTTTATCTTCACAGCCC | 2269 | TGTTATAAACCTGATGTTTCATA | 3521 |
| 2FH21F_18_204 | AAAATCTTTATATAGCTTGG | 1018 | GGTTAGTCTAAGATAAAACTC | 2270 | GAGTAAAGGAAGGAAAGGA | 3522 |
| 2FH21F_18_212 | GTTCCTCATGTCAGCTCTTG | 1019 | ACAACCAGTCCTACTGAAC | 2271 | TGAACTACTGAATGTTAGAAC | 3523 |
| 2FH21F_18_213 | ACTCAAGAGCTGACATGAGG | 1020 | GTCTACCCTGTCCATTGAAG | 2272 | TCCATTGAAGATGAGGACTCCTA | 3524 |
| 2FH21F_18_216 | CTGTGTTGATGTGGTAGCCC | 1021 | GTCACCCAGTATATTTCTCC | 2273 | TTCTCCCAAATAAAAGAGGA | 3525 |
| 2FH21F_18_217 | GTCACCCAGTATATTTCTCC | 1022 | CTGTGTTGATGTGGTAGCCC | 2274 | GTGGTAGCCCATCACTGGGTTGTAAA | 3526 |
| 2FH21F_18_219 | TATGTGTTATATTTTTTCTG | 1023 | CAATGCAAACACTTTTAAGAC | 2275 | TGATCCTTTTAACTCAATCCAAA | 3527 |
| 2FH21F_18_223 | CTTTAGAAGGATTTTCTTAT | 1024 | GTCAATAACAACATGTCC | 2276 | CAACAATGTCCATGAAAAACTTGATT | 3528 |
| 2FH21F_18_224 | CCAAAATTAATCTTCCATTCTG | 1025 | TATAGATTATTGAATCTGAC | 2277 | ATTGAATCTGACAATAATCATATT | 3529 |
| 2FH21F_18_226 | AGTACATCATTGGCACCTTG | 1026 | ACTGCATTTGAAGTAGATGG | 2278 | ATTTGAAGTAGATGGTAATGTAATAC | 3530 |
| 2FH21F_18_233 | GATGGAAGGAGTGGTAGTG | 1027 | TGTGCCTTTGCCGAAACCAG | 2279 | TGACCAGCATGACAAGGTGA | 3531 |
| 2FH21F_18_234 | TTTTCTATTTTAACTAACTG | 1028 | TACCCTCTGATGAGCATCAGC | 2280 | TGAGCATCAGCTAATATTTAATC | 3532 |
| 2FH21F_18_241 | TGACACATGACTTTTGTGCC | 1029 | TCATTTAATTAATCATCAGG | 2281 | AATTAATCATCAGGTTCTTTATCCTTA | 3533 |
| 2FH21F_18_243 | CAGTATTGGCTTATTATGTC | 1030 | CAGAGTAGGTGTCCTTACAG | 2282 | GACACGTTCCAGTATAAAATA | 3534 |
| 2FH21F_18_244 | CCAGGTGTTTTGGTAACCAG | 1031 | CAGGTGTTTTGGTAACCAG | 2283 | AAGGCACAGAGAAAGAAGTAATATC | 3535 |
| 2FH21F_18_245 | CAGGTGTTTTTTATACTTAC | 1032 | CCAGGTACTGTGTTGTTTTGAC | 2284 | CTGTGCCTTCAAAATTTCA | 3536 |
| 2FH21F_18_252 | GAAAACAAATGTCATTAGC | 1033 | TACTACGTTTTTATACTTAC | 2285 | TACTACGTTTTTTATACTTACTTTTTT | 3537 |
| 2FH21F_18_254 | GCTTCTCTAAGCTACTTTA | 1034 | TAGTCGACCCTGGGCAATT | 2286 | CCTGGGCAATTCCTTAAATACCAGATA | 3538 |
| 2FH21F_18_255 | CGTCTCCGAGTAAACTCAC | 1035 | GTAAGATGAATACACAAAGGC | 2287 | AGGCTAAATCTTCTAAAATCAAG | 3539 |
| 2FH21F_18_260 | GACAGAGAGGGTTAAGTTCT | 1036 | GGTTACATATCACTGCAAG | 2288 | ACTAAATCAATCTCATCATACATTC | 3540 |
| 2FH21F_18_261 | CCATAGCAAGATGAATTCAC | 1037 | ATGATACTCCCCAAAGTCTC | 2289 | CTCCCAAAGTCTCAGATAG | 3541 |
| 2FH21F_18_262 | CCATAGCAAGATGAATTCAC | 1038 | CTCCCAAAGTCTCAGATAG | 2290 | AATTGCAAAGCCAATTAAAAAAC | 3542 |
| 2FH21F_18_268 | ACCCTCATATGTCTGGTAGC | 1039 | AGAGAATTTGGGGCCTGCT | 2291 | GGCCTGGCTGACAGTAAAC | 3543 |
| 2FH21F_18_269 | AGTTCCACATGAACCTAGCG | 1040 | TGAGATAAGTGGCTACGTTG | 2292 | TAAGTGGCTACGTTGTGTCATATTG | 3544 |
| 2FH21F_18_270 | GTTGTGACTATTGTTATAG | 1041 | TGGTTCTCAACACTGACCAC | 2293 | CCACTAGTATTAACATACAGTTTA | 3545 |

TABLE 4A-continued

| | | | | |
|---|---|---|---|---|
| 2FH21F_18_271 | GAGTGTAGAGCTGTTACTGG | 1042 | GGACATATGGCCTTGCTTAG | 2294 | AGAAAGGTGACTAAGAGATTGTAGTTC | 3546 |
| 2FH21F_18_272 | CTCAGATTATAGGAGACAGAG | 1043 | GCTCCTACACTCTAGAAGAAG | 2295 | AAAATTGATGAATACTTAGTTCCC | 3547 |
| 2FH21F_18_273 | TGATGAATACTTAGTTCCC | 1044 | ATCTACAAAGGATAATCAG | 2296 | TGCACTGGAGAAATTAAAA | 3548 |
| 2FH21F_18_274 | AGGAAATTATCTACAAAGG | 1045 | ACTCTGTCTCCTATAATCTG | 2297 | TTAATTCTCCAGTGCAGTG | 3549 |
| 2FH21F_18_275 | CCTGAAGTATGTTAGTAGAC | 1046 | TCCTTTGTAGATAATTTCC | 2298 | TGTAGATAATTTCCTTTGTAAGTA | 3550 |
| 2FH21F_18_276 | TCCTTTGTAGATAATTTCC | 1047 | CCTGAAGTATGTTAGTAGAC | 2299 | AGTAGACAAAGAAGAAAAAGTGAAG | 3551 |
| 2FH21F_18_277 | TTTGTCCTTCATCTCTTACC | 1048 | TAAGTCATTACTTCTCAG | 2300 | TAGAAGACAGCATTTCCATTA | 3552 |
| 2FH21F_18_284 | ATATTGACTATAACTTAAATAT | 1049 | TGGTGGACGAATGTCAAAAA | 2301 | CGAATGTCAAAAATTTTAAAATATCA | 3553 |
| 2FH21F_18_292 | GTGATTGTAAAAATTATAGC | 1050 | CAGATTGACCACCTCCAAAG | 2302 | AGAAAGAGGGGAGGTAAATAATAAGA | 3554 |
| 2FH21F_18_293 | TGCTTTCGAATTTTTCAC | 1051 | CCCATTCTTCTTAATGTCAG | 2303 | AATGTCAGAAGCCCTTA | 3555 |
| 2FH21F_18_296 | CCCAAAGATTAACTTGAT | 1052 | ATATATCTGGGCCTGGCTAC | 2304 | TTCTCTTGTTCAAATTTCC | 3556 |
| 2FH21F_18_300 | CTCTCCATGATGTACTGTAG | 1053 | GCATACAGAGAGGAGCTAGT | 2305 | GAGGAGCTAGTCAGAACA | 3557 |
| 2FH21F_18_301 | AGAGAGGAGCTAGTCAGAAC | 1054 | CTCTCCATGATGTACTGTAG | 2306 | ATGATGTACTGTAGTAACACAC | 3558 |
| 2FH21F_18_303 | GATCTAGGTTGAAACTAGTTG | 1055 | ATTTGCCCAATGCAAGCCAG | 2307 | CAGAAGTGCAAGTTCAG | 3559 |
| 2FH21F_18_304 | GTTGAAACTAGTTGGGCTTC | 1056 | ATTTGCCCAATGCAAGCCAG | 2308 | GCAAGCCAGTAAATAATAAAAC | 3560 |
| 2FH21F_18_305 | GCCTCTTTCACTACCATGAG | 1057 | ATCTAACGAGGATCTGACC | 2309 | TCTGCACCACCTTTCTT | 3561 |
| 2FH21F_18_307 | GTTAATCAGAGCCAGCCAAG | 1058 | TCAATTCCTCTCTAAGAGCC | 2310 | AGCCACCGTAACTCTTTC | 3562 |
| 2FH21F_18_314 | GAAGGAAGGTGGGTTCTGTG | 1059 | CGCCGCACATCCCCTCTCG | 2311 | CGCCGCACATCCCCTCTCGCCCCTC | 3563 |
| 2FH21F_18_319 | CTGAATTCTTTGGGAGGGC | 1060 | TGAGAGTCATCAAAAGTC | 2312 | GTCCAAGTTTAGTGAAGATG | 3564 |
| 2FH21F_18_326 | AAAGGACGAAAGCAACGG | 1061 | AACCTGTTCAGTGCTGCC | 2313 | CAGTGCTGCCAGTCAAC | 3565 |
| 2FH21F_18_327 | TGTTCAGTGCTGCCAGTCAA | 1062 | AAAGGACGAAAGCAACGGG | 2314 | TGATCCCACGCTGCTACTCA | 3566 |
| 2FH21F_18_328 | TGTTCAGTGCTGCCAGTCAA | 1063 | AAAGGACGAAAGCAACGGG | 2315 | CGAAAGCAACGGGGAAAAAAA | 3567 |
| 2FH21F_18_329 | CCCGAAAAGTTTCAGAAG | 1064 | ACTGATTTCCCAGCACCCAC | 2316 | CTGATTTCCCAGCACCCACTGTCCC | 3568 |
| 2FH21F_18_330 | TTCCCTGATTACACTGTGCC | 1065 | CATTTATAGTCTATACGTGC | 2317 | ATAGTCTATACGTGCAGTGCAGGGTT | 3569 |
| 2FH21F_18_332 | ATGTAGGCATTGTAATGAGG | 1066 | GACTTGAATTAACTGCTCCC | 2318 | TTGAATTTAACTGCTCCAGTAAGG | 3570 |
| 2FH21F_18_333 | AGTATAATATTTGGCATTC | 1067 | CTGGGGCAAGGTTGGGAT | 2319 | AAGAGAAACAACATAATCTGA | 3571 |

TABLE 4A-continued

| | | | | | |
|---|---|---|---|---|---|
| 2FH21F_18_340 | AGCGCACAGCGTTCCGCA | 1068 | TGGGGCTCGCAGCTGCGAGA | 2320 | GGGCCTTGCCATTCTCA | 3572 |
| 2FH21F_18_344 | CGAGTAAGTAAATGTGAGTGG | 1069 | CCCTTTTCTACTCACATTCC | 2321 | GCTAATTAGTGCTATTGGCTG | 3573 |
| 2FH21F_18_346 | AACTTGCCTTCAAGATCTG | 1070 | GATAACATAAGATTAGGAAC | 2322 | AACATAAGATTAGGAACAAGAATA | 3574 |
| 2FH21F_18_349 | TCAGAACCTTTTGAAAAC | 1071 | CCAATAGGCATTGCTAAACT | 2323 | CTTTGCATATTCTTTTACGAAACGC | 3575 |
| 2FH21F_18_350 | TTCGGTCAAGGCTTACTATG | 1072 | GTTCTGAATTTAGATGTACGG | 2324 | ACGGAATAGGAAAATTCTCCA | 3576 |
| 2FH21F_18_351 | AGTGTGCTATACTGGACTAC | 1073 | ACTCTTAGCCCTTTCACAGC | 2325 | CTCTTAGCCCTTTCACAGCATTGAT | 3577 |
| 2FH21F_18_352 | ACTCTTAGCCCTTTCACAGC | 1074 | AGTGTGCTATACTGGACTAC | 2326 | GGTAAGGTGGCAAGTCAA | 3578 |
| 2FH21F_18_354 | TTAGCCTTTCCCTGCTTTG | 1075 | CGTCAAGTGAGTATACTGTG | 2327 | AAAACGTGGAAAATACAAAAAAA | 3579 |
| 2FH21F_18_355 | GTTAAAACGTGGAAAATAC | 1076 | AAAATATATATTGAAAGAAAAC | 2328 | TTAGCCTTTTCCCTGCTTTGATTTT | 3580 |
| 2FH21F_18_357 | AAAGAATAAAACGTAAACTC | 1077 | TGGGAGGAATGTGAGTTGGG | 2329 | TTGTAGAATTGGAGTTAAGATAGGAT | 3581 |
| 2FH21F_18_364 | TGCACGCAGCATCACCAGT | 1078 | CCACACACAGTAAGAGCCAC | 2330 | CACAGTAAGAGCCACTCGGACA | 3582 |
| 2FH21F_18_365 | ACACACAGTAAGAGCCACTC | 1079 | TGCACGCAGCATCACCAGT | 2331 | GTGCCCGGCTGAGGTGCGT | 3583 |
| 2FH21F_18_369 | CCCACCAGGCACCTGCTCT | 1080 | AAGATCAGGAATGGACAGGG | 2332 | CCCGCAAGAGGGCAAAG | 3584 |
| 2FH21F_18_370 | AGCCCTCGCTGCTTCCCCACA | 1081 | ATATGAGGAGGACTCACTG | 2333 | CTGGAGCTGGGAGGGGTTTGA | 3585 |
| 2FH21F_18_375 | TGAGGTGGCCTATGTTCCC | 1082 | ATGGGTCTGGCAAGGTTGG | 2334 | TGTGGCTTTTAGGGCGA | 3586 |
| 2FH21F_18_380 | GAGTCACCAACTGCCCCCA | 1083 | AGTTCTGTTGGGCAGAGTTC | 2335 | GTTGGGCAGACTTCTGTGGAGACC | 3587 |
| 2FH21F_18_386 | TCATAGCACAAGTCTCAGGG | 1084 | ACATGTGGTGTGCCTGTGTC | 2336 | TGCCTGTGTCCACCTAA | 3588 |
| 2FH21F_18_388 | AGGAGACCCCCTCACCTATG | 1085 | ATGCCCCCTCCTCCCTATAC | 2337 | TCCTCCCTATACCGGTACAA | 3589 |
| 2FH21F_18_398 | AGCGCCTGAGTGCCCTGAG | 1086 | TCCTAGCAGCCATGCAATC | 2338 | TGGCAATCCACAGGGAGC | 3590 |
| 2FH21F_18_399 | TCCTGCCTGCCCAGCACCAT | 1087 | GGAACACTGTGGACTTGTTG | 2339 | TGGACTTGTTGAGGAGGCT | 3591 |
| 2FH21F_18_402 | CTGCACACTGCAGGGTATG | 1088 | AGGCCAAGAGAGGCACAAG | 2340 | GCACACCTGCCTGCTCCTCTTGGAC | 3592 |
| 2FH21F_18_403 | CAAGTGCAGTCTGTCCTC | 1089 | AGAGGTCCTCAGAGACCAG | 2341 | AGGACAGGGTCTGTT | 3593 |
| 2FH21F_18_405 | TGAGGACTGCTCTATGACCG | 1090 | CTGCTGGATCTGGTAGTCA | 2342 | GATCTGGTAGTCAGAGAAG | 3594 |
| 2FH21F_18_408 | GGAGATAACAGAGTGTTTCC | 1091 | TGCTCATCTGAGGCCTCAGT | 2343 | GGGGCCTGGCCTCA | 3595 |
| 2FH21F_18_409 | TGCTCATCTGAGGCCTCAGT | 1092 | TAACAGGTGTTTCCAGTTGC | 2344 | GGGTGCTGAGGCCCCAGTGAG | 3596 |
| 2FH21F_18_412 | TCGCGGAGATCAACTTCAAC | 1093 | TGCCTGATGACCCCGAC | 2345 | TCGCTCACACTGTCCTC | 3597 |
| 2FH21F_18_414 | TTCCCAGGCAGTCAGGCCG | 1094 | TCCACAGAGGGGCCTCTCC | 2346 | CCAGCCCCACCGCACAGCCCAC | 3598 |

TABLE 4A-continued

| | | | | | |
|---|---|---|---|---|---|
| 2FH21F_18_415 | AGGCCCTCTGTGGAGCTA | 1095 | GCTTAGTTCAGGATGTGGGC | 2347 | GCCATGGGCTGGAGGGCATGATGGG | 3599 |
| 2FH21F_18_417 | GCCTTCACCTGGGCAGCAC | 1096 | TGAGGCCTGCTGCAGCGAC | 2348 | CATCCAGCACTTTGATGA | 3600 |
| 2FH21F_18_419 | GTCCTGCAAGCACTGGCG | 1097 | AGAATGCCCTGAGTGAGGAG | 2349 | TCCAGGCCTCAGCTCCG | 3601 |
| 2FH21F_18_427 | TGGGTGGTGTCCACCTAGT | 1098 | GCTGGGGTGGGCATCAGG | 2350 | CTGGGGTGGGCATCAGGCCTGTG | 3602 |
| 2FH21F_18_428 | CCTAGATGTCAGCCGTGAG | 1099 | CACAGGCCTGATGCCCAC | 2351 | CTGATGCCCACCCCAGC | 3603 |
| 2FH21F_18_429 | CACAGGCCTGATGCCCACC | 1100 | CCTAGATGTCAGCCGTGAG | 2352 | CGTGAGGGTGGAGGCCAG | 3604 |
| 2FH21F_18_430 | AAGGAGAGGGGTCTTATCAG | 1101 | CCTCCACCCTCACGGCTGA | 2353 | CACGGCTGACATCTAGG | 3605 |
| 2FH21F_18_432 | ACCCTCACGGCTGACATCTA | 1102 | GGGTAAGGAGAGGGGTCTT | 2354 | GAGAGGGGTCTTTATCAGCC | 3606 |
| 2FH21F_18_434 | ACGTCCCAGATAGGAGGAAG | 1103 | AGGACCCGCATCCAACAGAGA | 2355 | GCAGCTCACCAAGCACCAC | 3607 |
| 2FH21F_18_435 | TCATCCTTGAGGCCAGGGAG | 1104 | ATGCCACTGCCCCTGTCCTAT | 2356 | CCAGGACCCGCATCCAACAGAGA | 3608 |
| 2FH21F_18_441 | TTTCTGCTGGTAACAAATG | 1105 | GAGGACAGGGTCAGTCCCG | 2357 | CACTTCCTGACACGGCCCC | 3609 |
| 2FH21F_18_446 | TCCTGCAGAGGCCTAGCCTT | 1106 | TCCCACTGACCCCAAGGAG | 2358 | GCTGGCCTCAGGCCTTA | 3610 |
| 2FH21F_18_457 | TGACACTGGGCATAGTGTGG | 1107 | CAGAGCAAGCCCCTTAGATG | 2359 | CCCCTCCTGTACCTTGG | 3611 |
| 2FH21F_18_459 | TTGGGATCATGGCACAGG | 1108 | TCCAGGCTGCGTTCAGATTC | 2360 | TCAAGCACCTCATTCTC | 3612 |
| 2FH21F_18_460 | TGATGACCTCAAACCTCCG | 1109 | TTGGGATCATGGCACAGG | 2361 | GAGAATGAGGTGCTTGATGATG | 3613 |
| 2FH21F_18_461 | TTCTTTGTTCGTGGGTAGTG | 1110 | GCAGTTTAAACCACCATTTC | 2362 | CCACCATTTCTGTGAAGCTTTCT | 3614 |
| 2FH21F_18_462 | TGCCTGTTACCAGGTACTAC | 1111 | GTGCAGCACAGAACAACGC | 2363 | CTTTGTTCGTGGGTAGTGT | 3615 |
| 2FH21F_18_463 | CTGATTATCTTTTTCTAAGC | 1112 | AGTCCTAACTGAAAGACAGA | 2364 | GAAAGACAGACAAGAACATCTTA | 3616 |
| 2FH21F_18_466 | AATCTGGGTTTCCTTGAGGG | 1113 | TTAGCAACTGACTGTCATA | 2365 | AACTGACTGTCATAAAGAGAT | 3617 |
| 2FH21F_18_467 | GCAACTGACTGTCATAAGAG | 1114 | AATCTGGGTTTCCTTGAGGG | 2366 | GGGTTTCCTTGAGGGCTAAGATTACT | 3618 |
| 2FH21F_18_468 | GGAAGAATCTGAGAAGTAGC | 1115 | ATAAGGTGAGGCTTGCGCTG | 2367 | GGATGCAGTTCTGGAAACAAGA | 3619 |
| 2FH21F_18_469 | AGTCTTTAGTTCCTCCAGAC | 1116 | CTTCCCTGATGATGAATGGC | 2368 | TGAATGGCTCATCCCAG | 3620 |
| 2FH21F_18_470 | GCAGCCCAGATCTTGGTTAC | 1117 | CCTCAGAAATAGCATGCAGG | 2369 | TGAAGTGGTGTGGTTG | 3621 |
| 2FH21F_18_472 | TCCTAGACTCTTTCCTGTGG | 1118 | ACCTGAATGTGCATGGGAAG | 2370 | GAATGTGCATGGGAAGTTCTGGAAT | 3622 |
| 2FH21F_18_474 | TGAGATTGAGTTCGCTCCTG | 1119 | CAAGGCTTGGGTAAGAAGGG | 2371 | TGGCATTCAGAGAGCAT | 3623 |
| 2FH21F_18_475 | AAGGACACCCTGACAAGATAG | 1120 | AAGAAGAGACCCCCTTCTTACCC | 2372 | GGATAAAAAGCAAGACTCT | 3624 |

TABLE 4A-continued

| | | | | |
|---|---|---|---|---|
| 2FH21F_18_476 | AGAATCAGAGTCCAGCTCAG | 1121 | CTGCTCTATCTGTCAGGTG | 2373 | TCTTTGTCAGGTGTCCTTGAAATT | 3625 |
| 2FH21F_18_480 | GACCCACAAATATGAGTCAG | 1122 | TAGTGGAAAGGAGGAGTTCGG | 2374 | TAGACCCAGAGTCCCATA | 3626 |
| 2FH21F_18_481 | GGAAATGGATTACAGCCCTC | 1123 | CGTCAAAAGTGAGTGGGAAG | 2375 | GAGTGGGAAGAATACAGT | 3627 |
| 2FH21F_18_482 | GGGCTGTAATCCATTCCTG | 1124 | TATGAAGGTTGCAAAGAGGG | 2376 | GAAGGTTGCAAAGAGGGGTGAAT | 3628 |
| 2FH21F_18_483 | TCTCTTTCCATTCCAGTGA | 1125 | CACCCCTCTTTGCAACCTTC | 2377 | AACAGCCCAAGGTCTTAC | 3629 |
| 2FH21F_18_485 | GTGTAAGAGAGGACCTTT | 1126 | TTGGATGAGGCACAGTGAG | 2378 | ACAGTGAGGAATTTGGTCTG | 3630 |
| 2FH21F_18_490 | TCCCTTGAATGTTGGAAGGA | 1127 | ATTGAGTTAGCACTGGCTCC | 2379 | GCACTGGCTCCAATCTGATCAATT | 3631 |
| 2FH21F_18_491 | AGAGCCAGTTTGCATTCAC | 1128 | GGAACTAAGGCAAAGATGAAG | 2380 | CACCTGTCACCAAGACAC | 3632 |
| 2FH21F_18_494 | TCAGAATGGGTCTGAGTTTC | 1129 | CAGGCAAGAGGTCTTTTCCAG | 2381 | TCTTTCCAGATTCCCCA | 3633 |
| 2FH21F_18_497 | CATGGGCTAAGCCATGTAAG | 1130 | GTTGCCTCATCTTTCCCTTC | 2382 | TCCCTTCTGAGAAGTCTA | 3634 |
| 2FH21F_18_501 | CACATTCAGAGCAGCTATG | 1131 | CAGGGTGAGGAATACATTGG | 2383 | GGAATACATTGGCTGTATGTGATTTT | 3635 |
| 2FH21F_18_502 | CTAAATCAAATTACTGTGCC | 1132 | TCAGCAGCTCTGTCTTTATG | 2384 | CTTGCCTTCAAAGCAAAAG | 3636 |
| 2FH21F_18_503 | TTGGCTCCAGTTCACTTTCAG | 1133 | CCTTCATAACGTTATACACC | 2385 | ATACACCACATTGCTAAAAA | 3637 |
| 2FH21F_18_504 | CCTTCATAACGTTATACACC | 1134 | AGGGCTTTCTGTCTGTGCTG | 2386 | TCTGTGCTGCGCTGGCTCT | 3638 |
| 2FH21F_18_505 | TGAAAGTGACTGGAGCCAAG | 1135 | TGCGTGTCAGAAGATGCTAC | 2387 | ACGGAATGAGCCGAGAGTG | 3639 |
| 2FH21F_18_506 | TGCGTGTCAGAAGATGCTAC | 1136 | TGAAAGTGACTGGAGCCAAG | 2388 | CTCTCGGCTCATTCCGT | 3640 |
| 2FH21F_18_508 | ACTCGCAGACTAGTCCCGT | 1137 | CGAGAAATGGTGAGTGTGGG | 2389 | CCGAGACTGGGAGGGG | 3641 |
| 2FH21F_18_509 | ACGGGGACCTAGTCTGCGAGT | 1138 | TGCAGGGACCAGGACAGGAC | 2390 | GAGGGGACTGAGGGCTGAGCTGCAGA | 3642 |
| 2FH21F_18_510 | CTTGCTGACATTTCCCCAAAG | 1139 | CTGAAATGTGCAATAAAGG | 2391 | ATGTGCAATAAAGGACAAAAA | 3643 |
| 2FH21F_18_511 | CAAATTGCCATCCATTCCACTGCTC | 1140 | GTCCTTTATTGCACATTTCAG | 2392 | TATTGCACATTTCAGAAACAGTATTT | 3644 |
| 2FH21F_18_512 | GAGCAGTGGATGGCAATTTG | 1141 | AGTGCCAGGGGATTATTTTC | 2393 | ATGTGAAATATTTGTAAGTAGAAAA | 3645 |
| 2FH21F_18_513 | AGCAGAAAATAATCCCCTGG | 1142 | TAAGGGCGTTTGTGCTAAGG | 2394 | AGAAACAGCAGAAAGATTTTTTACAG | 3646 |
| 2FH21F_18_515 | AGCACAAACGCCCTTATTAG | 1143 | CCGAAGTGGCTAAGGAAAC | 2395 | AAACATTGCCCCATAAAGTTCCCAA | 3647 |
| 2FH21F_18_516 | GATGGCCAAGATACAAACC | 1144 | CTGGAAGATTACCAAAGGGC | 2396 | TATTCACCAGAACTCCCAAAA | 3648 |
| 2FH21F_18_517 | TGTGTCCTCTGAAGATTAC | 1145 | GCCCAAGATACAAACCAGAG | 2397 | TTTGGGAGTTCTGTGAATA | 3649 |
| 2FH21F_18_518 | CATTCAGCTGCTCCTTTGAG | 1146 | CAGCCCCTTTGGTAATCTTC | 2398 | ATCTTCAGAGGACACA | 3650 |
| 2FH21F_18_519 | GGTAATCTTCCAGAGGACAC | 1147 | GATATTTCTCTCACCCCCAG | 2399 | CTGCTCCTTTGAGAAGCTG | 3651 |

TABLE 4A-continued

| | | | | | |
|---|---|---|---|---|---|
| 2FH21F_18_520 | AGTGCAAGAACCTGCAAAGC | 1148 | TCACTGAAGTGCTCAATGCC | 2400 | CTGCACTGTGCCCACT | 3652 |
| 2FH21F_18_521 | CAGAAGAAAGACATCACTGG | 1149 | TGTGTGCAGAACAAAGCCTC | 2401 | TTCCCTCAGACACCTGGAGTCTCCTT | 3653 |
| 2FH21F_18_522 | GTAAAACTTTGTCGTGGGAG | 1150 | CCTACACATGCTTCTAACCCAC | 2402 | ACCCACTCCTGAACATA | 3654 |
| 2FH21F_18_523 | CTTCTAACCCACTCCTGAAC | 1151 | AAGCTGTTGTGAGCACAATT | 2403 | GTAAAACTTTGTCGTGGGAGGA | 3655 |
| 2FH21F_18_524 | TAAGCCAGGAGTCTTCTAGG | 1152 | TGTGCTCACAACAGCTTTCC | 2404 | CAGCTTTCCTCCTAGAG | 3656 |
| 2FH21F_18_525 | TGTGCTCACAACAGCTTTCC | 1153 | TAAGCCAGGAGTCTTCTAGG | 2405 | GCACCTGTGTATGTTCT | 3657 |
| 2FH21F_18_526 | CAGGTTCCCGATAGAGATTC | 1154 | CATACACAGGTGCCTAGAAG | 2406 | AGACTCCTGGCTTATCT | 3658 |
| 2FH21F_18_527 | TGCTACAGATACAGGCTCAG | 1155 | ACCCAGGTTTCTTGGACTAC | 2407 | ACCTGATCATAATCTCTTCTGATTGT | 3659 |
| 2FH21F_18_529 | CAGAGCCATAATCACAACTG | 1156 | AGCTAAGTCTGAGGTAAGGG | 2408 | ACTCTACTCCACTAACAGTTTACA | 3660 |
| 2FH21F_18_530 | TGTTCTTCCCCTTACCTCAG | 1157 | CAGATCCCGAATCTAGCTGT | 2409 | AGATCCCGAATCTAGCTGTAATATCCC | 3661 |
| 2FH21F_18_534 | GACCATGACTGCTTCATCTC | 1158 | GATCTGGAGACTTCAAACTGG | 2410 | GGAGACTCAAACTGGTCAATAAGCTA | 3662 |
| 2FH21F_18_535 | TTGATGCCACCAACTGAAGG | 1159 | AATATTTATTCTTAGCAAGG | 2411 | AATAATAACTCTCTCTCTGTCC | 3663 |
| 2FH21F_18_536 | ACCCTTACGTTTCTTAGAG | 1160 | GGACAGAGAGAAGTTATT | 2412 | ACAGAGAGAAGTTATTATTGTATT | 3664 |
| 2FH21F_18_537 | TTGGGACAGATCTCCATGC | 1161 | CAGATTCTCTTGGTCAGGC | 2413 | GCTTAGAAAGATAAAACTGAAA | 3665 |
| 2FH21F_18_538 | TTTCAGTGTGGATCAGACC | 1162 | CATGGAGATCTGTCCCAACC | 2414 | GCGCAGATCCACCCTCT | 3666 |
| 2FH21F_18_539 | GCTCATTTAGACAGATGGAG | 1163 | TTCTTCACAAGTCTCAAAG | 2415 | GAATTGCAGTTAACAGTTCCTTTC | 3667 |
| 2FH21F_18_543 | CCAGAAGTTTGAGTATCAC | 1164 | GGACTAAGCGTAAATTTGC | 2416 | TTTTCCCTTTGGCTTTTTCAATCATCT | 3668 |
| 2FH21F_18_545 | CTATTTCAGTTCTAACCCT | 1165 | GCAGATAAGTCAAAACAGG | 2417 | TCAAAACAAGGACAATCTAA | 3669 |
| 2FH21F_18_548 | GAGACATATATCAAGGAATAA | 1166 | GTTTCAAAACCAACATGGTA | 2418 | AAAAACCAACATGGTAAAATCTAAATA | 3670 |
| 2FH21F_18_549 | CCCTCTGACAAAAAGAGAGC | 1167 | GAGGTCCTTGCCTTATCAC | 2419 | GTCCTTGCCTTATCACCACCATT | 3671 |
| 2FH21F_18_555* | CAAGGAATTTAGAAAATGC | 1168 | AAGTTTCCTGTAGAAAGAG | 2420 | TTCCTGTAGAAAGAGTTAAAGTGAAT | 3672 |
| 2FH21F_18_565* | TCACATTTACCAACTACTG | 1169 | TTCTACATTCCTGGCCTGAG | 2421 | AACAGAAGTACCTTTTGCTTAT | 3673 |
| 2FH21F_18_566* | AATGTCAGGTTGTTGACTGC | 1170 | TTAGATATGGCTGAGAAGTG | 2422 | ATATGGCTGAGAAGTGGGGTGA | 3674 |
| 2FH21F_18_567* | AGATATGGCTGAGAAGTGGG | 1171 | AATGTCAGGTTGTTGACTGC | 2423 | TAAGTTAAAGTGGGTCAGGT | 3675 |
| 2FH21F_18_570* | GACAGGAGCTCTATATTTA | 1172 | CATACAAGTAAAGAACCCA | 2424 | CTAACCTGCTACCTACCTT | 3676 |
| 2FH21F_18_571 | CTAACCTGCTACCTACCTT | 1173 | TGAAGTTATAAATCAGTAAG | 2425 | GTTATAAATCAGTAAGAAACAGGA | 3677 |

TABLE 4A-continued

| | | | | |
|---|---|---|---|---|
| 2FH21F_18_574* | TCTCTCTGTAAGATGTGAAG | ATGGAGAGATGGCAAGTGAG | 1174 | GCTGAGGAACACAGCTCCCTATG | 2426 | 3678 |
| 2FH21F_18_576* | TCTTCACATCTTACAGAGAG | GCTGACAGCATCAGCTTTAG | 1175 | AACAGATTAGATTCCATGTAACTA | 2427 | 3679 |
| 2FH21F_18_577* | CTACTAAAGCTGATGCTGTC | CTCAAAATGTGTCTACAAGC | 1176 | GTGTCTACAAGCATAATGAA | 2428 | 3680 |
| 2FH21F_18_579* | CTGTCAGCTGCCATGCTTAG | ACCTTCTTAGAAGTTTCTC | 1177 | CTTCTTAGAAGTTTCTCTTCTAGAT | 2429 | 3681 |
| 2FH21F_18_583* | CTTGGTAATATATATATAGTG | GAGCACTATGTATTGTTTTC | 1178 | ACTTGCTTGCATCATACAT | 2430 | 3682 |
| 2FH21F_18_585 | TGAATGTCTTCAGGGTGAGG | CTGAAGGAGAAGAAGGGAAC | 1179 | ACTTCCTCCCCTGAGTC | 2431 | 3683 |
| 2FH21F_18_590 | AAACAAAGCCTTTGAGACC | ACAACATACTCGTATCTCC | 1180 | CGTATCTCCTGAAATCCTG | 2432 | 3684 |
| 2FH21F_18_594 | AAAACATTTTAATGCACTTC | GTATTGAAAGGTCAGTGTG | 1181 | CAGTGGTGGTAAGACAA | 2433 | 3685 |
| 2FH21F_19_004 | AATTTTCATCTATTCTCAAG | CTTTTATATCCTTCTCATGT | 1182 | AATTCATATGCTTTGCTACTC | 2434 | 3686 |
| 2FH21F_19_005 | CCAGAAGGCCTTCAAAATAAG | GAGTAGCAAAGCATATGA | 1183 | GTAGCAAAGCATATGAATTTA | 2435 | 3687 |
| 2FH21F_19_006 | GAGTAGCAAAGCATATGAA | CCAGAAGGCCTTCAAAATAAG | 1184 | AACTTTTATATCCTTCTCATGT | 2436 | 3688 |
| 2FH21F_19_007 | CCAGAAGGCCTTCAAAATAAG | GAGTAGCAAAGCATATGAA | 1185 | GAAGGATATAAAAGTTTGTTTTCTG | 2437 | 3689 |
| 2FH21F_19_010 | GCAACTAAAAGAAACAGACC | CCATGTCTTTATTAGCAACC | 1186 | GCCATAGATGAGATCTCCAACCT | 2438 | 3690 |
| 2FH21F_19_012 | TCATCAAACAAGATGGTAT | CAGAGTATGAAGCAGTTG | 1187 | AGAGTATGAAGCAGTGTGGAGC | 2439 | 3691 |
| 2FH21F_19_014 | ACTGCAAACTCAGTAAAGG | GCTCTAGCTCTCCAAGCTTTG | 1188 | TCAAGCTTTGGGTGAAT | 2440 | 3692 |
| 2FH21F_19_015 | CCAAAGCTTGAGAGCTAGAG | TCCCAAGGGATTATCACC | 1189 | GCATTTCATCTACTCAGTTAC | 2441 | 3693 |
| 2FH21F_19_016 | TCCCAAAGGAATTATCACC | CCAAAGCTTGAGAGCTAGAG | 1190 | GTAACTGAGTAGATGAAATGC | 2442 | 3694 |
| 2FH21F_19_018 | TTCAATAGCAAGCAAGTTT | ATTCCCTTTGGGAAGAAGTG | 1191 | ATCTTTAATTATTCCACTTTTTGTTA | 2443 | 3695 |
| 2FH21F_19_022 | AGAATTCCTCTAATATGAC | GCTGCCTTACACAGTCTTTT | 1192 | GTTTATTTGATCATGTATTATCCCTT | 2444 | 3696 |
| 2FH21F_19_026 | CTTCTTCAATACATAAGAAC | TTTTGGCCTAAAAATGAGGT | 1193 | TTGGCCTAAAAATGAGGTTTTTTG | 2445 | 3697 |
| 2FH21F_19_027 | GAGCACTGAGCCATAAAGG | AAAAACCTCATTTTTAGGC | 1194 | AACCTCATTTTTAGGCCAAAATAA | 2446 | 3698 |
| 2FH21F_19_023 | CCTCATTTTTAGGCCAAAATA | GAATGAGCACTGAGCCATA | 1195 | AATGAGCACTGAGCCATAAAAGGT | 2447 | 3699 |
| 2FH21F_19_030 | TTTTTCATTGCATAGACTG | GATCAAGTTCTAAATCTCAGG | 1196 | AAGTTCTAAATCTCAGGAATAAAA | 2448 | 3700 |
| 2FH21F_19_031 | GTTTTTTACAGGCTGGTGG | CACACATGTGAAAGGCATGG | 1197 | ATGGTTCAACTGTTCTGC | 2449 | 3701 |
| 2FH21F_20_003 | AGAAGGATAGGATTTGTGAG | GTTCTACGCTAGAAATCAAC | 1198 | TAGAAATCAACTTTCCTTCTATGC | 2450 | 3702 |
| 2FH21F_20_004 | GTTCTACGCTAGAAATCAAC | AGAAGGATAGGATTTGTGA | 1199 | GGATAGGATTTGTGAGATTTA | 2451 | 3703 |
| 2FH21F_20_006 | AAAGAAACATGGGTGTGAG | TCTCACAAATCCTATCCTTC | 1200 | CTGAAATGTATGTACCCTTCC | 2452 | 3704 |

TABLE 4A-continued

| | | | | |
|---|---|---|---|---|
| 2FH21F_20_007 | TCACCACCCATGTTCTTTG | 1201 | TGGACTAGAAAGAAGGCAGG | 2453 | AAGAAGGCAGGTACAGGAG | 3705 |
| 2FH21F_20_008 | TCACACAAAGCAGTAGCAGG | 1202 | TCCTGTACCTGCCTTCTTTC | 2454 | CCTGCCTTCTTTCTAGTCCAGAATAC | 3706 |
| 2FH21F_20_009 | TCCTGTACCTGCCTTCTTTC | 1203 | TCACACAAAGCAGTAGCAGG | 2455 | CAGTAGCAGGATGGTTATT | 3707 |
| 2FH21F_20_010 | GGGACCATGGTGTGGTTTTG | 1204 | TCCTGCTACTGCTTTGTGTG | 2456 | AATTTACTTTTCCAAAATAAGTCA | 3708 |
| 2FH21F_20_011 | CTGCTTTGTGTGAAATTCTCC | 1205 | ATTGGCTGGGACCATGGTGT | 2457 | ACCATGGTGTGGTTTTG | 3709 |
| 2FH21F_20_012 | AGGGTGGTTACAGGTTGATG | 1206 | TGCTCTATTCTGACTGCCTG | 2458 | CTCTATTCTGACTGCCTGCCACCCCTC | 3710 |
| 2FH21F_20_013 | GAGAGTAACTGAAGGAGGTG | 1207 | AACATCAACCTGTAACCACC | 2459 | CCTGTAACCACCCTAATC | 3711 |
| 2FH21F_20_014 | ACATCAACCTGTAACCACCC | 1208 | GAGAGTAACTGAAGGAGGTG | 2460 | AGTAACTGAAGGAGGTGCATTT | 3712 |
| 2FH21F_20_015 | AGAAATAACATACCCAGGGC | 1209 | CACCTCCTTCAGTTACTCTC | 2461 | CTTTGTTCAATGCCTCCTTTAT | 3713 |
| 2FH21F_20_016 | CACCTCCTTCAGTTACTCTC | 1210 | AGAAATAACATACCCAGGGC | 2462 | CCCAGGGCTAGGCATAA | 3714 |
| 2FH21F_20_017 | AGGAAACTGGTCTTCCCTTG | 1211 | TATGCCTAGCCCTGGGTATG | 2463 | CCTGGGTATGTTTATTCTCTTAC | 3715 |
| 2FH21F_20_018 | TATGCCTAGCCCTGGGTATG | 1212 | AGGAAACTGGTCTCCCTTG | 2464 | TCTTCCCTTGAAGAGCCTCCCC | 3716 |
| 2FH21F_20_020 | ATGGCCGGGCTCGGTTAGT | 1213 | TTCAGCAAAGGAGAGAGACC | 2465 | GCTCGGTTAGTAAGTGG | 3717 |
| 2FH21F_22_012 | GTGTTAAACGGGGTTTGAGC | 1214 | GTAGCGTGGCCTTTCTGAAC | 2466 | GCAGTTTACCTCCTTCTAC | 3718 |
| 2FH21F_22_016 | TCAGCAGGAACAAGTCTAGG | 1215 | GAATGTTGGCCAGTGGCAG | 2467 | AGGGTGGGCCTGGGCCTGAGGGAA | 3719 |
| 2FH21F_22_017 | GAATGTTGGCCAAGTGGCAG | 1216 | CTCTGTCAGGAACAAG | 2468 | TCAGCAGGAACAAGTCTAGGGG | 3720 |
| 2FH21F_22_018 | CTCCAGTGACAGATGCAAAC | 1217 | CCCTAGACTTGTTCCTGCTG | 2469 | AGACTTGTTCCTGCTGACAGAG | 3721 |
| 2FH21F_22_019 | TGAGGACCCCTTTGTGAGCAG | 1218 | GGGCAAATCAGTGAAGATCA | 2470 | GTGAAGATCAAAATCCCTC | 3722 |
| 2FH21F_22_021 | TCTCCTGCAGGGCCCTGCCT | 1219 | GACACACAAACAGCCTGAG | 2471 | GCCTGAGGGTGCCCAGTC | 3723 |
| 2FH21F_22_025 | ATGGTGTGTGGCAGTGTGAG | 1220 | TCCACACAGTGGTTCTTCAG | 2472 | AAGCCTCCTATGCTTGCC | 3724 |
| 2FH21F_22_026 | CCTCCACACAGTGGTTCTTC | 1221 | ATGGTGTGTGGCAGTGTGAG | 2473 | GGCAAGCATAGGAGGCTTTATGGA | 3725 |
| 2FH21F_22_028 | ATCCTTCACCTCCTTTGCAC | 1222 | AGTGAGAAGGTTGTCACCAG | 2474 | TCACCAGCCCTCACTAATACCC | 3726 |
| 2FH21F_22_029 | AGTGAGAAGGTTGTCACCAG | 1223 | ATCCTTCACCTCCTTTGCAC | 2475 | CTCCTTTGCACACGGGCT | 3727 |
| 2FH21F_22_030 | GGTCCCAGGCCCAGAGGGTT | 1224 | GAGGATGGGTTTATATTG | 2476 | GGATGGGTTTATATTGGGAAAA | 3728 |
| 2FH21F_22_035 | TGTTCCTGGGCCCGACAGCCT | 1225 | GGGCAGATGTTTCCTCTGA | 2477 | AGGGTGCCGTGTTGGCAGC | 3729 |
| 2FH21F_22_036 | GGGCAGATGTTTCCTCTGA | 1226 | CTGCCAACACCGCACCCTT | 2478 | AACACCCGCACCCTTCCACC | 3730 |
| 2FH21F_22_037 | GTGGTTAGTTTGCTGGTGAC | 1227 | GAGACAGTCACTATATGACA | 2479 | ATGACATAAATCCACTTAGC | 3731 |

TABLE 4A-continued

| | | | | | |
|---|---|---|---|---|---|
| 2FH21F_22_040 | GCTCTTCCACCGGTTTTAC | 1228 | AACCAGGGACTCCACCCTTC | 2480 | GACTCCACCCTTCTCCAGAG | 3732 |
| 2FH21F_22_042 | CTCTGGCGAGCCCTCTTAC | 1229 | TGTAGGAGCCGAGGTGGAG | 2481 | GGTGGAGCCGCCAGCTGT | 3733 |
| 2FH21F_22_043 | TGTAGGAGCCGAGGTGGAG | 1230 | CTGGCTCTGGCGAGCCCT | 2482 | TCTGGCGAGCCCTCTTACC | 3734 |
| 2FH21F_22_044 | TTGGTGCCATTTGGGAGAAC | 1231 | CTGAAGTTCACTCGCTGTC | 2483 | TTAAAGCTTGCCACCTGTTTTGTTG | 3735 |
| 2FH21F_22_047 | ACAAAACAAATCTTATAGAC | 1232 | CAGTCAAGTAAAAGAACGC | 2484 | GAAACGCAACTAAAAGAGC | 3736 |
| 2FH21F_22_048 | ACAAAACAAATCTTATAGAC | 1233 | AGAAACGCAACTAAAAGAGC | 2485 | TCAGTTAAATACATTCCTCT | 3737 |
| 2FH21F_22_051 | TTTAATGTTAAACCTTGTG | 1234 | TAACCTAAGCAGAATTTTC | 2486 | TTTGACAGAAAGTAACAGCTTCA | 3738 |
| 2FH21F_22_055 | TAACCTTCCAAAGAAGTGCC | 1235 | CTGCTGAAGCCCTATTTTG | 2487 | AGCCCTATTTGAAATTTCCCTTTT | 3739 |
| 2FH21F_22_056 | TCACCACCTGGAAGTGAGTC | 1236 | GGGAAATTTCAAAATAGGGC | 2488 | GAAATTTCAAAATAGGGCTTCAGCAG | 3740 |
| 2FH21F_22_057 | TCAAAATAGGGCTTCAGCAG | 1237 | CTCACACCTGGAAGTGAGT | 2489 | CCTGGAAGTGAGTCCCACC | 3741 |
| 2FH21F_22_059 | ACTTCCAGGTGTGAGAC | 1238 | CTGACCGGGAGTGAGTGAGAAG | 2490 | GGCCCAGAGCAGCCGAT | 3742 |
| 2FH21F_22_061 | TGGCCCCTGCCTGTTGCCTT | 1239 | TACCTGGAGACAGAAACAGC | 2491 | GAGACAGAAACAGCCAGGATCA | 3743 |
| 2FH21F_22_062 | TACCTGGAGACAGAAACAGC | 1240 | CACACACAGAGCCTGGTGG | 2492 | GCCTGGTGGCCCTGCCTGTTGCCTT | 3744 |
| 2FH21F_22_067 | CATGGACCTTCCAGCTTATG | 1241 | TTCTCTCCTTCTATAATGGC | 2493 | TTCTCTCCTTCTATAATGGCTTATTT | 3745 |
| 2FH21F_22_068 | GCCAACAATTATGAAGCAG | 1242 | GGAATATCTCCTTGGCCTTC | 2494 | GAATATCTCCTTGGCCTTCCTATCTAA | 3746 |
| 2FH21F_22_073 | TTGGGCGCTTTTTCCAAGG | 1243 | AGGACCCACCTGGCTCTCA | 2495 | TCAGCGGGAGAGCAGGGA | 3747 |
| 2FH21F_22_074 | ATCAGGCAGCTGGTGGTCCT | 1244 | TATTGGAGAGTCCGCATGAG | 2496 | CCCTGCTGCACTCACTC | 3748 |
| 2FH21F_22_075 | TGGTCCCTGCTGCACTCACT | 1245 | TGCTCCATGCTCACCATCAG | 2497 | TCAGGCAGCTGGTGGTCCTT | 3749 |
| 2FH21F_22_076 | TCAGGTATGGTTTTGCTGGG | 1246 | TTTACCAGCTATTCCCCC | 2498 | GCTATTCCCCTAATCCTA | 3750 |
| 2FH21F_22_077 | GTTTGAACCACTCTTCCTG | 1247 | GGTCCAGAAATAGCTACAGG | 2499 | CAGAAATAGCTACAGGAAGA | 3751 |
| 2FH21F_22_078 | CTGTAGCTATTTCTGGACCC | 1248 | TTCCTTGCCTGATGATTTC | 2500 | TTTCTCTTTCTCCTCCC | 3752 |
| 2FH21F_22_079 | AAGTAGCAAATCAGCTTC | 1249 | AGAAAGCAGAGGTTTAGGAG | 2501 | TTTAGGAGAAAAAGAAGAGA | 3753 |
| 2FH21F_22_080 | GAGATTTGCTTGCCAATAGG | 1250 | GTCTCTCACCCCTTCATTT | 2502 | TTATTTCTTCTTGAGTACACTCTTA | 3754 |
| 2FH21F_22_081 | CTGTCTCTCACCCCTTCATT | 1251 | GATTTGCTTGCCAATAGGAG | 2503 | AGAAGAAATAACATTTTCCTGTATA | 3755 |
| 2FH21F_22_082 | GATTTGCTTGCCAATAGGAG | 1252 | CTGTCTCTCACCCCTTCATT | 2504 | TCACCCCTTCATTTAATTTA | 3756 |
| 2FH21F_22_085 | CCAATGAATGTCCTCATCAG | 1253 | GCAGCGTGATTCCTATGAAG | 2505 | GAAGAAGGCATCTCGGATAATGA | 3757 |

Table 4B shows the common nucleotide sequence for each assay and a mismatch in brackets between the first nucleotide sequence species and the second nucleotide sequence species.

Lengthy table referenced here

US09926593-20180327-T00001

Please refer to the end of the specification for access instructions.

Example 3: Detecting Fetal Aneuplodies—Model Systems and Plasma Samples

The multiplexed assays designed according to the methods of Example 3 and provided in Table 4 were tested in a series of model systems to identify the best performing assays. Assays were analyzed based on the following characteristics:
1. Low overall process variability.
2. Low differences between ethnic groups.
3. Large differences between normal and T21 samples.
4. Strong relationship between allele frequency and fraction of T21 DNA in the sample.
5. High 'discernibility' between normal samples and samples containing T21 DNA.

After the assays were screened across the different model systems, the best performing assays from the model systems were further validated in plasma samples.

Model System Selection

Processes and compositions described herein are useful for testing circulating cell-free DNA from the maternal plasma for the presence or absence of fetal aneuplodies. Plasma samples from pregnant women, however, are limited and variable in nature. Thus, they are not the ideal sample for performing controlled studies designed to specifically challenge performance aspects of the marker performance. Therefore, synthetic model systems were created that meet the following criteria:
1) Come from a renewable resource to allow for follow-up and subsequent longitudinal studies
2) Provide an indication of how the marker will perform when assayed against plasma samples
3) Be able to assess the basic functionality of each marker with metrics such as extension rate and allele skew
4) Provide a genetically and ethnically diverse sample set to indicate the population coverage of each marker
5) Allow for repeated measurement of the same biological sample to assess marker stability
6) Be dynamic and tunable to allow for analysis at defined ranges, such as fetal contribution, to develop a more robust characterization of each marker's capabilities and limitations Model System Design From the list of model system performance criteria provided above, a series model system sets were derived. The model system can be broken down into three major components: basic functionality, technical replicate variance and biological replicate variance. These model system sets allowed for the analyses at extremes of fetal contribution and provided an ethnically and genetically diverse sampling.

DNA Set 1: Basic Marker Functionality

This set was composed of 121 normal euploid samples (normal karyotype cell lines) representing African, Asian, Caucasian, and Mexican ethnic groups, as well as 55 T21 aneuploid samples (T21 cell lines). These samples were distributed over two 96-well plates. These samples were used to assess the following:
1) If the marker is functional on a basic level, including extension rate and allele skew from the 50% theoretical;
2) If the marker is able to distinguish 100% normal euploid samples from 100% T21 aneuploid samples; and
3) If the marker has a strong ethnic bias when compared to other ethnic populations.

Figure 5:
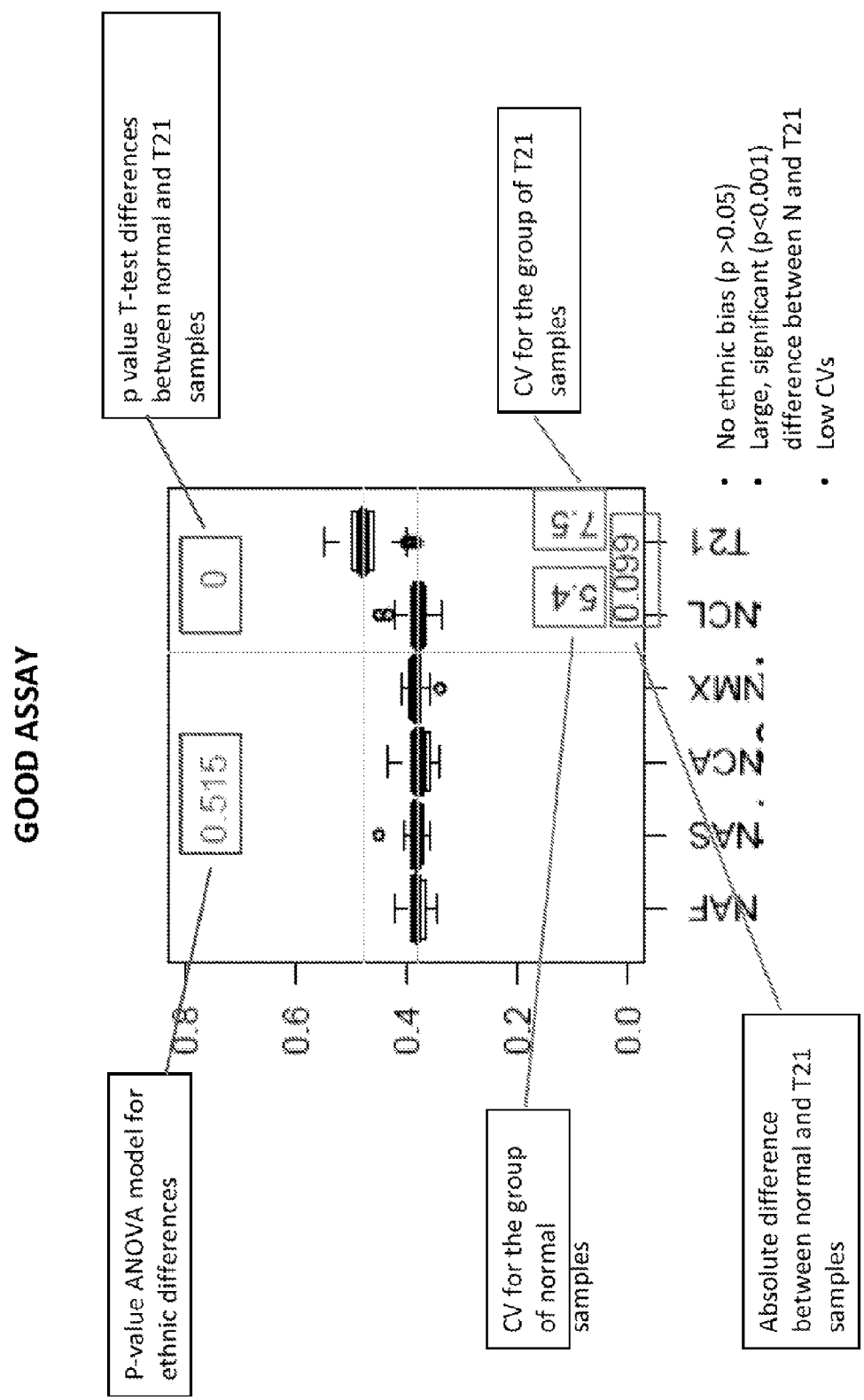
FIG. 5 shows an example of a working assay from the model system DNA Set 1: no ethnic bias ($p>0.05$); Large, significant ($p<0.001$) difference between N and T21; Low CVs.
Figure 6:
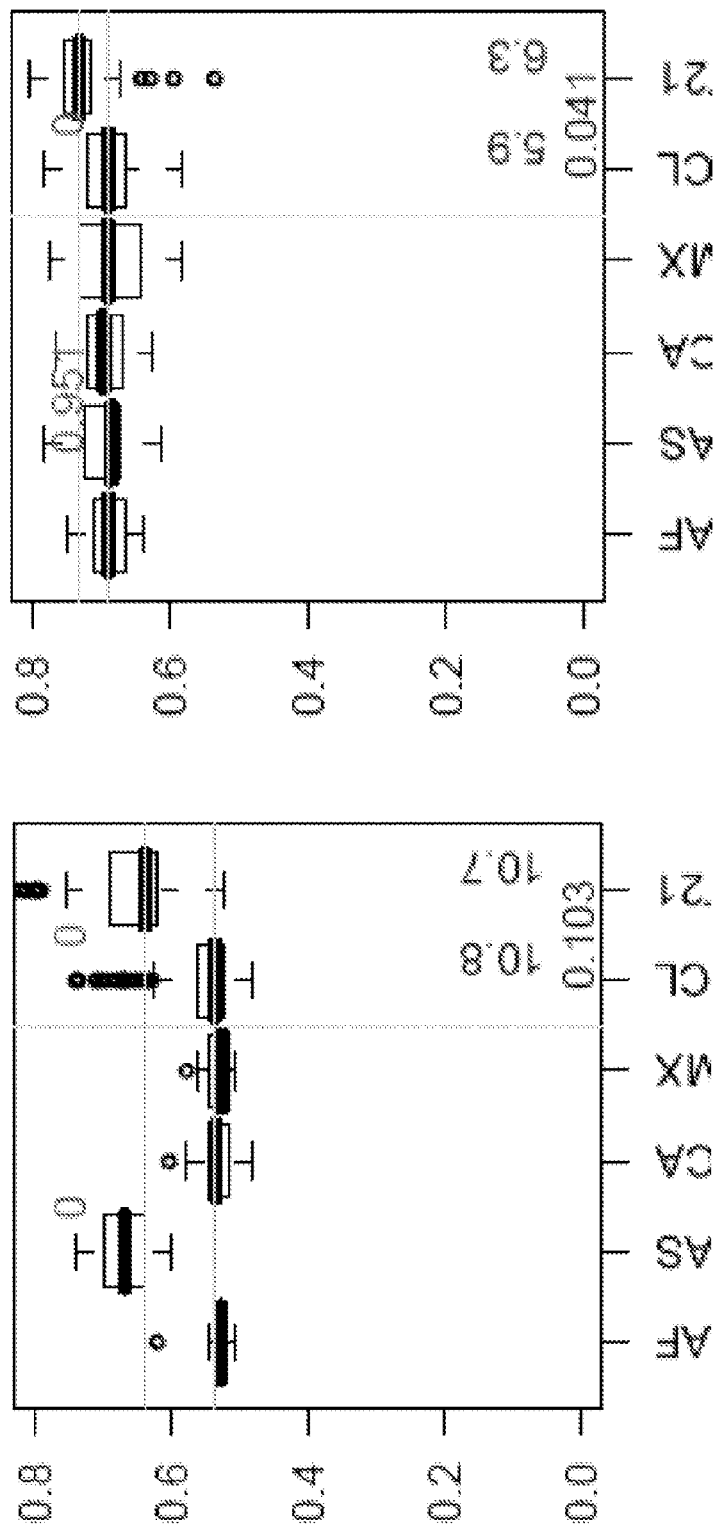
FIG. 6 shows an example of two poor assays from the model system DNA Set 1: Ethnic bias ($p<0.001$) and large variance.
Figure 8:
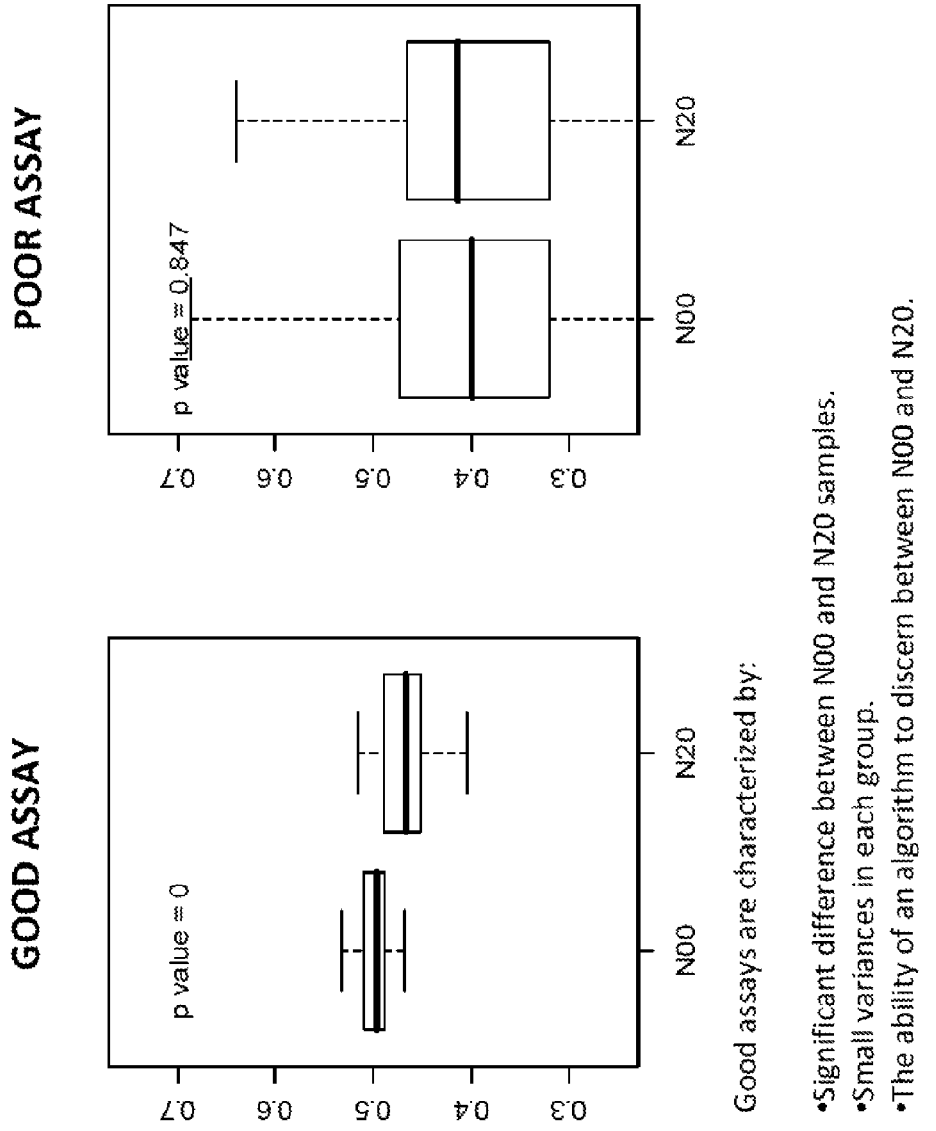
FIG. 8 shows an example of a working assay and a poor assay based on DNA set 3.

Assays that performed well in this model set showed minimal ethnic bias, have a significant difference between N and T21, and low CV's. See FIG. 5. Assays that performed poorly showed an ethnic bias, do not have a significant difference between N and T21, and high CV's. See FIG. 6.

DNA Set 2: Variances in Replicates

This set was composed of a single euploid DNA sample (from a single diploid cell line) to simulate the maternal background, and a single spiked-in T21 aneuploid DNA sample (from a single T21 cell line) to simulate circulating fetal DNA. The simulated fetal T21 spike-in DNA was replicated 22 times at 0, 5, 7.5, 10, 12.5, 15, 20 and 30% of the simulated maternal background for a total of 176 samples. These samples were distributed over two 96-well plates. These samples were used to assess the following:
1) What is the CV (technical variance) of each marker in the 22 PCR technical replicates; and
2) What affect does increasing the simulated fetal DNA T21 spike-in, from 0 to 30.0%, have on the T21 allele frequency of each marker in the technical replicate samples?

Assays that performed well in this model set showed a linear response, a good match of expected "allele" frequency vs. observed "allele" frequency (where "allele" refers to the detectable sequence mismatch), and a large difference between N00 and N30. See FIG. 7—good assay. Assays that performed poorly showed no linear response, no difference between N00 and N30, and large technical variance. See FIG. 7—poor assay.

DNA Set 3: Variances in Biological Replicates

This set was composed of 44 different euploid DNA samples (from diploid cell lines) to simulate circulating maternal background paired with 44 different aneuploid T21 DNA samples (from T21 cell lines) to simulate circulating fetal DNA. The simulated fetal T21 spike-in DNA was replicated 44 times at 0, 5, 10, and 20% of the simulated maternal background for a total of 176 samples. These samples were distributed over two 96-well plates. These samples were used to assess the 'discernibility' between normal samples and T21 DNA, or more specifically:
1) What is the CV of each marker in the 44 biological replicates; and
2) What affect does increasing the simulated fetal DNA T21 spike-in, from 0 to 20.0%, have on the T21 allele frequency of each marker in the biological replicate samples?

Assays that performed well in DNA Set 3 showed a significant difference between N00 and N20 samples, small variances in each group, and the ability of an algorithm to discern between N00 and N20.

Model DNA Samples

Concentrations

Concentrations in the model system were adjusted to simulate, in a simplified manner, plasma derived samples. For a clinical test, 10 mL of whole blood would likely be obtained from the mother, which yields ~4 mL of plasma.

Under optimized conditions, DNA extraction from plasma obtains ~25 ng of DNA in 100 μL. Given this clinical constraint for tests that assay nucleic acid from plasma samples, the model DNA concentrations were normalized to ~0.25 ng/μL. The DNA concentrations of the spiked-in DNA used to simulate the fetal contributions were selected to range from 0%-30% with a mean value of 15%. These values were selected based the estimated ranges and mean values for fetal DNA contribution in maternal plasma.

Sample Source

The model DNA was provided by Coriell DNA repository from a total DNA extraction of cultured cell lines with known ethnicity and T21 aneuploidy status. Coriell was chosen as a source of DNA for the model system because of their extensive history of providing essential research reagents to the scientific community. These collections, supported by funds from the National Institutes of Health (NIH) and several foundations, are utilized by scientists around the world and are extensive, well characterized and can be replenished at any time.

Euploid Model DNA

The euploid samples were chosen from well characterized DNA panels in the Coriell repository that represent four (4) ethnic groups:

African (AF)—INTERNATIONAL HAPMAP PROJECT—YORUBA IN IBADAN, NIGERIA. The HAPMAPPT04 plate, from the Yoruba in Ibadan, Nigeria includes a set of 28 trios, 2 duos, and 2 singletons with 90 samples. The concentration of each DNA sample is normalized and then this concentration is verified.

Asian (AS)—INTERNATIONAL HAPMAP PROJECT—JAPANESE IN TOKYO, JAPAN AND HAN CHINESE IN BEIJING, CHINA. The HAPMAPPT02 plate of 90 individual samples includes 45 Japanese in Tokyo and 45 Han Chinese in Beijing. The concentration of each DNA sample is normalized and then this concentration is verified.

Caucasian (CA)—INTERNATIONAL HAPMAP PROJECT—CEPH (UTAH RESIDENTS WITH ANCESTRY FROM NORTHERN AND WESTERN EUROPE). The HAPMAPPT01 plate, from the CEPH Collection, includes a set of 30 trios (90 samples). The concentration of each DNA sample is normalized and then this concentration is verified.

Mexican (MX)—INTERNATIONAL HAPMAP PROJECT—MEXICAN ANCESTRY IN LA, USA. These cell lines and DNA samples were prepared from blood samples collected from trios (mother, father, and child) from Communities of Mexican Origin in Los Angeles; CA. DNA samples from thirty trios have been included in the panel designated as HAPMAPV13. The concentration of each DNA sample is normalized and then this concentration is verified.

T21 Aneploid Model DNA

Fifty-five T21 DNA samples in the Coriell repository were used to generate a biologically diverse sampling of T21 to help increase the genetic robustness of the marker screening. The T21 samples were selected by identifying those Coriell samples with "Trisomy 21" as a description. The concentration of each DNA sample was normalized and verified.

Plasma Derived Samples

To extract DNA from maternal plasma samples, the QIAamp Circulating Nucleic Acid Kit (4 mL Procedure) was used. An outline of the extraction procedure is provided below.

Sample Collection and Preparation

The method is preferably performed ex vivo on a blood sample that is obtained from a pregnant female. "Fresh" blood plasma or serum, or frozen (stored) and subsequently thawed plasma or serum may be used.

Frozen (stored) plasma or serum optimally is frozen shortly after it's collected (e.g., less than 6-12 hours after collection) and maintained at storage conditions of −20 to −70 degrees centigrade until thawed and used. "Fresh" plasma or serum should be refrigerated or maintained on ice until used. Blood may be drawn by standard methods into a collection tube, preferably siliconized glass, either without anticoagulant for preparation of serum, or with EDTA, sodium citrate, heparin, or similar anticoagulants for preparation of plasma. The preferred method of preparing plasma or serum for storage, although not an absolute requirement, is that plasma or serum is first fractionated from whole blood prior to being frozen. "Fresh" plasma or serum may be fractionated from whole blood by centrifugation, using gentle centrifugation at 300-800×g for five to ten minutes, or fractionated by other standard methods. A second centrifugation step often is employed for the fractionation of plasma or serum from whole blood for five to ten minutes at about 20,000 to 3,000×g, and sometimes at about 25,000×g, to improve the signal to noise ratio in subsequent DNA detection methods.

Fetal DNA is usually detected in equal to or less than 10 ml maternal blood, plasma or serum, more preferably in equal or less than 20, 15, 14, 13, 12, 11, 10, 9, 8.5, 8.0, 7.5, 7.0, 6.5, 6.0, 5.5, 5.0, 4.5, 4.0, 3.5, 3.0, 2.5, 2.0, 1.6, 0.8, 0.4, 0.2 or 0.1 ml, and any intermediates values, of maternal blood, plasma or serum. Such fetal DNA is preferably detectable in a maternal blood sample during early pregnancy, more preferably in the first trimester of pregnancy and most preferably prior to week 22, 21, 20, 19, 18, 17, 16, 15, 14, 13, 12, 11, 10, 9 or 8 of gestation.

DNA Extraction Preparation Suggestions

Equilibrate samples to room temperature

If samples are less than 4 mL, bring up volume with PBS

Set up QIAvac 24 Plus

Heat waterbath to 60° C.

Heat heating block to 56° C.

Equilibrate Buffer AVE to RT

Ensure Buffer ACB, ACW1, ACW2 have been prepared properly

Add reconstituted carrier RNA to Buffer ACL according to chart

Note: After thawing, spin plasma samples at 1600 RPM for 10 minutes. This helps remove precipitates that may occur due to freeze/thawing cycles.

Procedure

1. Pipet 400 uL of Qiagen Proteinase K into a 50 mL centrifuge tube
2. Add 4 mL plasma to tube
3. Add 3.2 mL ACL with carrier. Close cap, and mix by pulse-vortexing for 30 seconds
4. Incubate at 60° C. for 30 minutes
5. Briefly Centrifuge the tube to remove drops from the inside of the lid
6. Add 7.2 mL of ACB to the lysate in the tube. Close cap and pulse-vortex for 15-30 seconds.
7. Incubate lysate/Buffer ACB mixture in the tube on ice for 5 minutes
8. Add lysate/Buffer ACB to tube extenders on columns. Switch on pump and when lysates have been drawn through column, turn each one off with their individual valves 9. After all lysates have gone through, control vacuum using valve for manifold
10. Using a Eppendorf Repeater and 5 mL Combitip, add 600 uL of ACW1 to each column
11. Add 750 uL of ACW2 to each column
12. Add 750 uL of absolute ethanol (200 proof) to each column
13. Remove tube extenders, close the lids on the columns, place columns in clean 2 mL collection tubes, and centrifuge at 20,000 rcf for 3 minutes
14. Place columns in new 2 mL collection tubes. Open the lids and incubate on 56° C. heat block for 10 minutes to dry the membrane completely
15. Place columns in clean collection tubes and add 110 uL of Buffer AVE to center of column
16. Close lids and incubate at RT for 3 minutes
17. Centrifuge columns in collection tubes at 20,000 rcf for 1 minute to elute DNA Assay Biochemistry and Protocol The nucleotide sequence species of a set share primer hybridization sequences that, in one embodiment, are substantially identical, thus they will amplify in a reproducible manner with substantially equal efficiency using a single pair of primers for all members of the set. Sequence differences or mismatches between the two or more species sequences are identified, and the relative amounts of each mismatch, each of which represents a chromosome, are quantified. Detection methods that are highly quantitative can accurately assay the ratio between the chromosomes. For example, provided below are exemplary methods and compositions for the detection and quantification of nucleotide sequence species using Sequenom's MassARRAY® System.

Polymerase Chain Reaction (PCR)

PCR Configuration

Samples to be analyzed, whether from the model system or from plasma, were subjected to PCR amplification. Given the dilute nature of the ccfDNA, the PCR will be performed in 96-well plate format with a total reaction volume of 50 µL composed of reagents and samples as outlined below in Table 5. In general, standard PCR conditions as outlined by the manufacture were used for the various experiments.

TABLE 5

Example PDA PCR Reaction

| Reagent | Supplier | Final Concentration | Volume (µL) |
|---|---|---|---|
| Water | N/A | N/A | 8.625 |
| 10x PCR Buffer (contains 20 mM MgCl$_2$) | *02100/Sequenom | 1.0x | 5.000 |
| PCR Nucleotide Mix (10 mM) ea | Roche | 200 µM | 1.000 |
| Primer Mix (0.5 µM) ea | IDT | 0.1 µM | 10.000 |
| 10 U/µL UNG | Roche | 6.25 U/rxn | 0.625 |
| 5 U/µL Fast Start | 01462/Sequenom | 5 U/rxn | 1.000 |
| MgCl$_2$-dye (20 mM) | *02100/Sequenom | **3.5 mM | 3.75 |
| Total = | | | 30.000 |

*Item Number 02100 is a kit and includes 10x PCR Buffer and 25 mM MgCl$_2$.
**The final concentration of MgCl$_2$ is 3.5 mM in each 50 µL reaction (2.0 mM from 10x PCR Buffer and 1.5 mM from the 20 mM MgCl$_2$-dye solution).

A 50 µL reaction volume was chosen for two reasons. The first is that the low concentration of circulating cell free DNA in plasma is between 1000 and 2000 genomic copies per µL, or 0.15-0.30 ng/µL requires more volume of sample to meet a minimum practical target value outlined by the reagent manufacture of ~5 ng per reaction. Secondly, because the PDA method relies on small copy number differences between two paralogous DNA regions in different chromosomal loci, a larger volume PCR reduces the effect from small changes of volume and concentration that may occur in the ordinary course of PCR preparation and may increase variability in the PCR amplification.

Post-PCR

Distribution to 384 Well Plate and Dephosphorylate

After transferring aliquots of the PCR amplicons to 384 well format, the remaining PCR primers and dNTPs were dephosphorylated using Shrimp Alkaline Phosphatase (SAP). The dephosphorylation reaction is performed at 37° C. and the enzyme is heat inactivated at 85° C.

TABLE 6

SAP Mixture

| SAP Mix Reagent | Item Number/ Vendor | Volume for N = 1 (µL) | Final Concentration |
|---|---|---|---|
| Nanopure Water | N/A | 1.536 | N/A |
| SAP Buffer (10X) | 10055/ Sequenom | 0.17 | 0.85x |
| Shrimp Alkaline Phosphatase (SAP) (1.7 U/µL) | 10002.1*/ Sequenom | 0.294 | 0.5 U/rxn |
| Total Volume | | 2 | |

*equivalent to SQNM product #10144

The 96 well PCR plates are centrifuged in a benchtop centrifuge to consolidate the PCR product. Using a Hamilton™ liquid handler, 4×5 µL aliquots are distributed to quadrants in a 384 well plate. Remaining PCR product (~30 µL) is stored at −20° C. for future use.

1. Using the Beckman 96 head MultiMek, 2 µL of SAP mixture dispensed to each 5 µL aliquot.
2. The plates were sealed with adhesive sealing film and centrifuge.
3. SAP dephosphorylation was performed in ABI 9700 thermal cyclers with the following program:

TABLE 7

SAP Reaction Thermal Profile

| Temperature | Time | Cycles | Comments |
|---|---|---|---|
| 37° C. | 40 minutes | 1 | Dephosphorylation step |
| 85° C. | 5 minutes | 1 | Inactivate SAP |
| 4° C. | forever | 1 | Store reaction |

Primer Extension Reaction

Single base primer extension was used to detect the allele genotype at a SNP location, or in this case, at the nucleotide mismatch location of interest. An extension primer with a specific sequence is designed such that the 3' end of the primer was located one base upstream of the fixed heterozygote location. During the extension portion of the cycle, a single base was incorporated into the primer sequence (single base extension), which was determined by the sequence of the target allele. The mass of the extended primer product will vary depending on the nucleotide added. The identity and amount of each allele was determined by mass spectrometry of the extended products using the Sequenom MassARRAY platform.

The extension mixture components are as described in the following table:

TABLE 8

Extension Mix Reagent Formulation

| Extension Reagent | Item Number/Vendor | Volume for N = 1 (µL) |
|---|---|---|
| Water (HPLC grade) | VWR_JT4218-2 | 0.4 |
| TypePLEX detergent free buffer (10x) | 01431*/Sequenom | 0.2 |
| TypePLEX Termination Mix | 01533**/Sequenom | 0.2 |
| Extend Primer Mix | IDT | 1 |
| Thermosequenase (32 U/µL) | 10052***/Sequenom | 0.2 |
| | Total Volume | 2 |

*equivalent to SQNM product #01449
**equivalent to SQNM products #01430 or #01450
***equivalent to SQNM products #10138 or# 10140

1. 2 µL of extension reaction mixture was added using the 96 head Beckman Coulter Multimek, bringing the total reaction volume to 9 µL.
2. The plate was sealed with adhesive sealing film and centrifuge with benchtop centrifuge.
3. The base extension reaction was performed in an ABI 9700 thermal cycler with the following cycling profile:

TABLE 9

Single Base Extension Thermal Cycling Profile

| Purpose | Temperature (° C.) | Time | Number of Cycles |
|---|---|---|---|
| Initial Denaturation | 94 | 30 seconds | 1 |
| Cycled Template Denaturation | 94 | 5 seconds | |
| Cycled primer Annealing | 52 | 5 seconds | 5 } 40 |
| Cycled primer Extension | 80 | 5 seconds | |
| Final Extension | 72 | 3 minutes | 1 |
| Hold | 4 | overnight | 1 |

4. After the extension reaction is complete, store the plate at 4° C. or continue to the desalting step.

Desalt Reaction with CLEAN Resin

The extension products were desalted of divalent cations (especially sodium cations) by incubating the samples with a cation-exchange resin prior to MALDI-TOF analysis.

Procedure
1. The plates were centrifuged in a benchtop centrifuge.
2. The 96 head Beckman Multimek was used to add 20 µL of autoclaved water to each well of the sample plate.
3. The Sequenom Resin Dispenser (Model # XXX) was used to add resin slurry to each sample well.
4. The plate was covered with an aluminum foil adhesive seal and rotated for at least ten minutes at room temperature.
5. The plate was centrifuged at 4000 rpm for five minutes before dispensing the sample to a SpectroCHIP.

Dispense Sample onto a SpectroCHIP and Analyze on MassARRAY System

Approximately 15-20 nL of each sample was dispensed onto a pad of a SpectroCHIP using a MassARRAY Nanodispenser. Following rapid crystallization of the sample, the analytes were ready to be scanned by MALDI-TOF.

Procedure
1. 3-point calibrant and samples were dispensed to a 384-spot SpectroCHIP using the RS-1000 Nanodispenser. Refer to the RS-1000 user's guide for more detailed instructions.
2. Note: different dispensing speeds may be necessary depending on the ambient temperature and humidity in the dispensing chamber. Typical dispensing speeds are 80 mm/sec for analytes and 100 mm/sec for the calibrant solution.
3. After dispensing, the plate was resealed and stored at 4° C. or −20° C. for longer term storage. The plate can be re-centrifuged and re-spotted if necessary.
4. The SpectroCHIP was placed in its storage case and stored in a dessicated chamber, if not analyzed immediately after spotting.
5. The SpectroCHIP was loaded into the PHOENIX MassARRAY analyzer and the user's guide was followed to analyze the chip and acquire/store the mass spectrum data.

Three Experiments Across Four Tiers (and 3 Model Sets+a Plasma Set)

The assays provided in Table 4 were tested during three different experiments:
Experiment 1—Selected Markers with Mix 1 Biochemistry (2 acyclo's+2 ddNTP's)
Experiment 2—Selected Markers with TypePLEX Biochemistry (all acylco's)
Experiment 3—Remaining assays not included in Experiment 1 or 2

During each experiment, samples were tested across four different tiers (or a combination thereof). Within each tier, the different DNA Sets (1, 2 or 3, or combinations thereof) were used to test the assay's performance.

Tier I. Run multiplex (MP) set on model system and filter out poor performing assays
Tier II. Re-Plex selected assays into new multiplex and run on model system
Tier III. Genomic Screening and select best performing 3 multiplex
Tier IV. Run the best assays on plasma samples for assessment of true performance. (Plasma sample extraction methods are described in below in the "Plasma Derived Samples" section)

Experiment 1

The results from the different tiers for Experiment 1 are described below, and the binary performance of each assay is outlined in Table 13, where "yes" indicates the assay passed the tier, and "-" indicates the assay was not tested or did not test.

Results from Tier I
250 assays in 10 multiplexes were tested on 6 different DNA plates
50% assays did not meet quality criteria
Good quality assays show some biological signal for the discrimination of euploid and Normal/T21 mixed samples
More T21 DNA allows better discrimination
Conclusion: The DNA model system is concise and can be used for marker identification.

Results from Tier II
From TIER ONE 5 Multiplexes are carried forward.
A total of 4 re-plexed Multiplexes (comprising top 40 assays) are tested.

Conclusions: Re-plexed assays show good performance and low dropout rate. Redesign of extend primers better than 'simple' re-plexing.

Results from Tier III
More than 400 genomic DNAs from 4 ethnic groups were tested on TIER II Multiplexes
less than 10% of the assays show genomic variability
For the remaining assays variability is observed in less than 1% of the samples (Processing variability needs to be excluded)

Conclusion: The filter criteria used during assays design are sufficient to identify highly stable genomic regions.

Results from Tier IV
57 assays were measured
75 Normal samples
23 T21 samples

Figure 9:
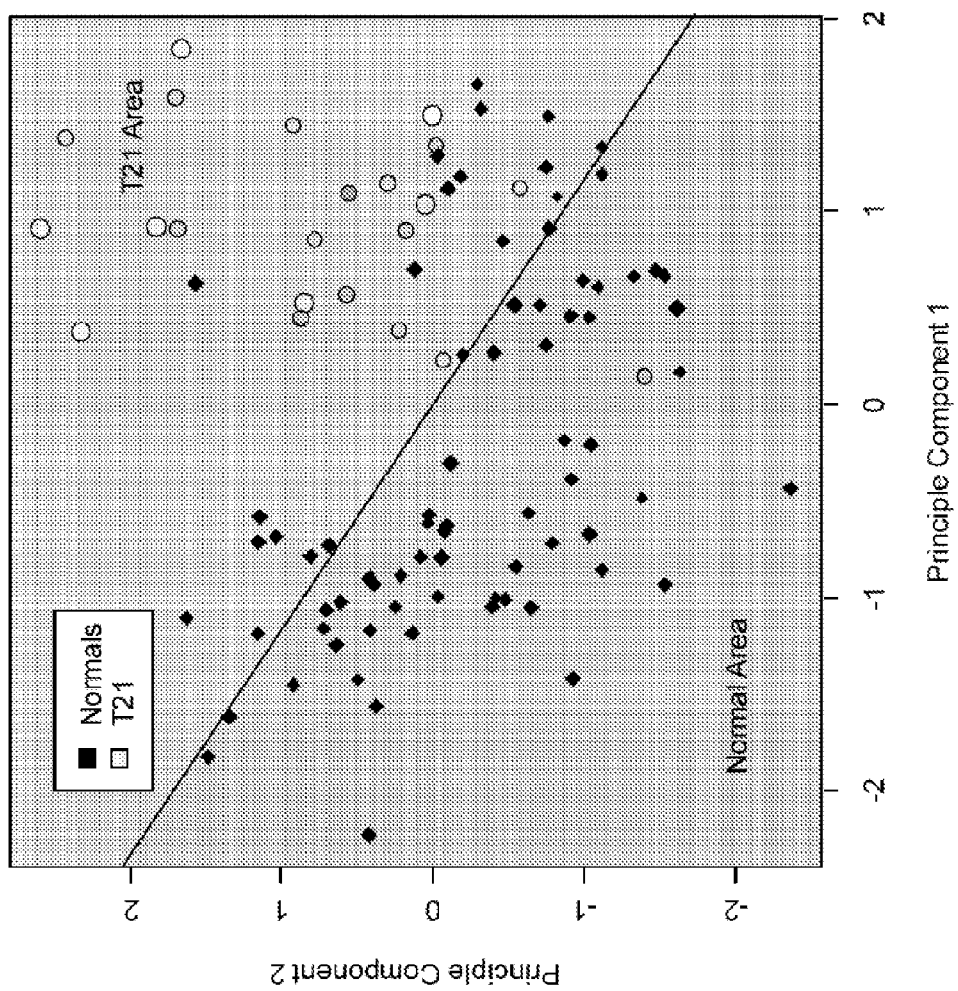
FIG. 9 shows results from Experiment I, Tier IV. The chart is based on a Simple Principle Component Analysis, and shows the two main components can separate euploid samples from aneuploid samples. Euploid samples are designated by diamonds and aneuploid samples are designated by circles in FIG. 9.

The results from Experiment I, Tier IV are provided in Table 10 and shown in FIG. 9. FIG. 9 results are based on a Simple Principle Component Analysis, and shows the two main components can separate euploid samples from aneuploid samples.

TABLE 10

Experiment I, Tier IV Plasma Results

| Method | Sensitivity | Specificity | AUC |
| --- | --- | --- | --- |
| Decision Tree | 55% | 85% | 0.73 |
| SVM - linear kernel | 77% | 91% | 0.84 |
| Logistic Regression | 77% | 84% | 0.89 |
| Naïve Bayes | 86% | 91% | 0.95 |
| Multilayer Perceptron | 91% | 93% | 0.97 |

Experiment 2—TypePLEX Extension Biochemistry
Experiment 2 was run using TypePLEX extension biochemistry and a new set of assays (see Table 4).
The entire feasibility was repeated using the TypePLEX biochemistry.
Selection of genomic target regions did not have to be repeated.
Assays were replexed after TIER 1.
Tier four included 150 euploid samples and 25 T21 samples.
Results of Experiment 2: TypePLEX Study
250 Markers were tested.
120 passed QC criteria to be replexed into 9 multiplexes.
3 Multiplexes comprising 54 markers were tested on Plasma samples.
>90% classification accuracy in the DNA model system.
150 euploid samples tested
24 T21 samples tested
Fetal Quantifer Assay (FQA) used to determine the amount of fetal DNA present in the samples after DNA extraction.

TABLE 11

Experiment 2, Tier IV Results (from all samples)

| Method | Sensitivity | Specificity |
| --- | --- | --- |
| Naïve Bayes | 34% | 97% |
| AdaBoost | 48% | 98% |
| Logistic Regression | 50% | 87% |
| Multilayer Perceptron | 61% | 94% |

TABLE 12

Experiment 2, Tier IV Results (from all samples with >12.5% or >15% fetal DNA)

| Method | Sensitivity | Specificity |
| --- | --- | --- |
| Naïve Bayes | 43% (52%)* | 97% (96%) |
| AdaBoost | 55% (72%) | 100% (100%) |
| Logistic Regression | 93% (99%) | 98% (99%) |
| Multilayer Perceptron | 75% (81%) | 97% (99%) |

*values in paranthesis represent samples with >15% fetal DNA

Of all the samples tested in Experiment 2, 111 samples had more than 12.5% fetal DNA and 84 samples had more than 15% fetal DNA. The FQA assay refers to the Fetal Quantifier Assay described in U.S. patent application Ser. No. 12/561,241 filed Sep. 16, 2009, which is hereby incorporated by reference. The assay is able to determine the amount (or concentration) of fetal DNA present in a sample.

Experiment 3—Remaining Assays

The remaining assays were analyzed across DNA Sets 1, 2 and 3 using Type PLEX biochemistry, and the results are provided in Table 13 below.

In one embodiment, a multiplexed assay is selected from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55 or more of the following nucleotide sequence sets 2FH21F_01_030, 2FH21F_01_041, 2FH21F_02_075, 2FH21F_02_076, 2FH21F_02_089, 2FH21F_02_091, 2FH21F_02_107, 2FH21F_02_111, 2FH21F_02_116, 2FH21F_02_148, 2FH21F_02_254, 2FH21F_03_005, 2FH21F_03_022, 2FH21F_05_003, 2FH21F_05_006, 2FH21F_05_027, 2FH21F_05_033, 2FH21F_05_061, 2FH21F_06_114, 2FH21F_06_165, 2FH21F_06_218, 2FH21F_06_219, 2FH21F_06_224, 2FH21F_06_238, 2FH21F_07_071, 2FH21F_07_166, 2FH21F_07_202, 2FH21F_07_464, 2FH21F_07_465, 2FH21F_09_007, 2FH21F_09_010, 2FH21F_10_005, 2FH21F_11_022, 2FH21F_11_028, 2FH21F_12_049, 2FH21F_12_052, 2FH21F_12_074, 2FH21F_12_075, 2FH21F_13_036, 2FH21F_13_041, 2FH21F_15_044, 2FH21F_18_020, 2FH21F_18_059, 2FH21F_18_076, 2FH21F_18_094, 2FH21F_18_154, 2FH21F_18_171, 2FH21F_18_176, 2FH21F_18_178, 2FH21F_18_188, 2FH21F_18_190, 2FH21F_18_191, 2FH21F_18_262, 2FH21F_18_270, 2FH21F_18_332 and 2FH21F_18_346, which correspond to those sequence sets carried to Tier IV of Experiment 3 (although not run on plasma samples). See Table 13 below.

Based on analysis of the designs and the results (both from the models and the plasma samples from all three experiments), one can conclude that investigating several regions in parallel, reduces the measurement variance and enabled accurate quantification of ccff DNA. Also, due to the low copy numbers that have to be detected it is desirable to have redundant measurements, which will increase the confidence in the results.

TABLE 13

| | Experiment 1 | | | Experiment 2 | | |
|---|---|---|---|---|---|---|
| Marker_ID | M1_All_211 tier 1 DNA set 1, 2, 3 | M1_Replex_90 tier 2 DNA set 1, 2, 3 | M1_Plasma_47 tier 4 plasma | TypePLEX_All_246 tier 1 DNA set 1, 2, 3 | TypePLEX_Replex_117 tier 2 DNA set 1, 2, 3 | TypePLEX_Plasma_50 tier 4 plasma |
| 2FH21F_01_003 | — | — | — | — | — | — |
| 2FH21F_01_006 | — | — | — | — | — | — |
| 2FH21F_01_007 | — | — | — | Yes | — | — |
| 2FH21F_01_009 | — | — | — | — | — | — |
| 2FH21F_01_010 | — | — | — | — | — | — |
| 2FH21F_01_011 | — | — | — | — | — | — |
| 2FH21F_01_012 | — | — | — | — | — | — |
| 2FH21F_01_013 | — | — | — | Yes | — | — |
| 2FH21F_01_014 | — | — | — | — | — | — |
| 2FH21F_01_015 | — | — | — | Yes | Yes | Yes |
| 2FH21F_01_017 | — | — | — | — | — | — |
| 2FH21F_01_018 | — | — | — | — | — | — |
| 2FH21F_01_020 | — | — | — | — | — | — |
| 2FH21F_01_021 | Yes | Yes | Yes | — | — | — |
| 2FH21F_01_022 | — | — | — | — | — | — |
| 2FH21F_01_023 | — | — | — | — | — | — |
| 2FH21F_01_025 | — | — | — | — | — | — |
| 2FH21F_01_026 | — | — | — | Yes | — | — |
| 2FH21F_01_027 | Yes | — | — | — | — | — |
| 2FH21F_01_029 | — | — | — | — | — | — |
| 2FH21F_01_030 | — | — | — | — | — | — |
| 2FH21F_01_031 | — | — | — | — | — | — |
| 2FH21F_01_033 | — | — | — | — | — | — |
| 2FH21F_01_034 | — | — | — | — | — | — |
| 2FH21F_01_036 | — | — | — | Yes | Yes | Yes |
| 2FH21F_01_037 | — | — | — | Yes | Yes | Yes |
| 2FH21F_01_038 | — | — | — | — | — | — |
| 2FH21F_01_039 | — | — | — | — | — | — |
| 2FH21F_01_040 | Yes | Yes | — | Yes | Yes | — |
| 2FH21F_01_041 | — | — | — | — | — | — |
| 2FH21F_01_043 | — | — | — | — | — | — |
| 2FH21F_01_044 | Yes | — | — | — | — | — |
| 2FH21F_01_045 | — | — | — | — | — | — |
| 2FH21F_01_046 | — | — | — | — | — | — |
| 2FH21F_01_049 | — | — | — | Yes | Yes | — |
| 2FH21F_01_050 | — | — | — | — | — | — |
| 2FH21F_01_057 | — | — | — | Yes | — | — |
| 2FH21F_01_058 | Yes | Yes | — | — | — | — |
| 2FH21F_01_059 | — | — | — | — | — | — |
| 2FH21F_01_060 | — | — | — | — | — | — |
| 2FH21F_01_062 | — | — | — | — | — | — |
| 2FH21F_01_063 | — | — | — | — | — | — |
| 2FH21F_01_064 | — | — | — | — | — | — |
| 2FH21F_01_065 | — | — | — | — | — | — |
| 2FH21F_01_067 | — | — | — | — | — | — |
| 2FH21F_01_068 | — | — | — | — | — | — |
| 2FH21F_01_071 | — | — | — | — | — | — |
| 2FH21F_01_072 | Yes | Yes | — | — | — | — |
| 2FH21F_01_073 | — | — | — | — | — | — |
| 2FH21F_01_077 | — | — | — | — | — | — |
| 2FH21F_01_078 | — | — | — | — | — | — |
| 2FH21F_01_080 | — | — | — | — | — | — |
| 2FH21F_01_081 | — | — | — | — | — | — |
| 2FH21F_01_082 | Yes | Yes | Yes | — | — | — |
| 2FH21F_01_083 | — | — | — | Yes | Yes | Yes |
| 2FH21F_01_084 | — | — | — | — | — | — |
| 2FH21F_01_086 | — | — | — | — | — | — |
| 2FH21F_01_088 | — | — | — | — | — | — |
| 2FH21F_01_090 | — | — | — | Yes | — | — |
| 2FH21F_01_093 | Yes | — | — | — | — | — |
| 2FH21F_01_094 | Yes | — | — | Yes | — | — |
| 2FH21F_01_099 | — | — | — | — | — | — |
| 2FH21F_01_101 | — | — | — | — | — | — |
| 2FH21F_01_102 | Yes | — | — | — | — | — |
| 2FH21F_01_104 | — | — | — | — | — | — |
| 2FH21F_02_003 | — | — | — | — | — | — |
| 2FH21F_02_007 | — | — | — | Yes | Yes | — |
| 2FH21F_02_015 | — | — | — | Yes | Yes | — |
| 2FH21F_02_017 | — | — | — | Yes | Yes | — |
| 2FH21F_02_018 | — | — | — | — | — | — |
| 2FH21F_02_019 | — | — | — | — | — | — |
| 2FH21F_02_020 | Yes | Yes | — | — | — | — |
| 2FH21F_02_021 | — | — | — | — | — | — |

TABLE 13-continued

| | | | | | | |
|---|---|---|---|---|---|---|
| 2FH21F_02_022 | — | — | — | Yes | — | — |
| 2FH21F_02_023 | — | — | — | — | — | — |
| 2FH21F_02_027 | — | — | — | — | — | — |
| 2FH21F_02_034 | — | — | — | — | — | — |
| 2FH21F_02_035 | — | — | — | Yes | Yes | Yes |
| 2FH21F_02_036 | — | — | — | — | — | — |
| 2FH21F_02_037 | — | — | — | Yes | — | — |
| 2FH21F_02_038 | — | — | — | — | — | — |
| 2FH21F_02_040 | — | — | — | — | — | — |
| 2FH21F_02_041 | — | — | — | — | — | — |
| 2FH21F_02_043 | — | — | — | — | — | — |
| 2FH21F_02_045 | — | — | — | — | — | — |
| 2FH21F_02_050 | — | — | — | — | — | — |
| 2FH21F_02_055 | — | — | — | Yes | Yes | Yes |
| 2FH21F_02_057 | — | — | — | — | — | — |
| 2FH21F_02_058 | — | — | — | — | — | — |
| 2FH21F_02_061 | — | — | — | Yes | Yes | — |
| 2FH21F_02_062 | — | — | — | — | — | — |
| 2FH21F_02_063 | — | — | — | Yes | Yes | — |
| 2FH21F_02_065 | — | — | — | — | — | — |
| 2FH21F_02_066 | — | — | — | — | — | — |
| 2FH21F_02_067 | — | — | — | — | — | — |
| 2FH21F_02_072 | — | — | — | — | — | — |
| 2FH21F_02_073 | — | — | — | — | — | — |
| 2FH21F_02_074 | — | — | — | — | — | — |
| 2FH21F_02_075 | — | — | — | — | — | — |
| 2FH21F_02_076 | — | — | — | — | — | — |
| 2FH21F_02_077 | Yes | — | — | Yes | Yes | Yes |
| 2FH21F_02_088 | — | — | — | Yes | — | — |
| 2FH21F_02_089 | — | — | — | Yes | Yes | — |
| 2FH21F_02_090 | — | — | — | — | — | — |
| 2FH21F_02_091 | — | — | — | — | — | — |
| 2FH21F_02_103 | — | — | — | — | — | — |
| 2FH21F_02_107 | Yes | Yes | Yes | — | — | — |
| 2FH21F_02_108 | — | — | — | — | — | — |
| 2FH21F_02_111 | Yes | Yes | Yes | — | — | — |
| 2FH21F_02_113 | — | — | — | Yes | Yes | — |
| 2FH21F_02_116 | — | — | — | Yes | Yes | — |
| 2FH21F_02_127 | — | — | — | — | — | — |
| 2FH21F_02_129 | — | — | — | — | — | — |
| 2FH21F_02_132 | — | — | — | — | — | — |
| 2FH21F_02_134 | — | — | — | — | — | — |
| 2FH21F_02_139 | Yes | Yes | — | — | — | — |
| 2FH21F_02_143 | — | — | — | — | — | — |
| 2FH21F_02_144 | Yes | — | — | — | — | — |
| 2FH21F_02_145 | — | — | — | — | — | — |
| 2FH21F_02_146 | — | — | — | — | — | — |
| 2FH21F_02_148 | — | — | — | — | — | — |
| 2FH21F_02_150 | — | — | — | Yes | — | — |
| 2FH21F_02_151 | — | — | — | — | — | — |
| 2FH21F_02_155 | — | — | — | — | — | — |
| 2FH21F_02_156 | — | — | — | — | — | — |
| 2FH21F_02_157 | — | — | — | — | — | — |
| 2FH21F_02_158 | — | — | — | — | — | — |
| 2FH21F_02_159 | — | — | — | — | — | — |
| 2FH21F_02_163 | — | — | — | — | — | — |
| 2FH21F_02_168 | — | — | — | — | — | — |
| 2FH21F_02_170 | — | — | — | Yes | Yes | — |
| 2FH21F_02_172 | — | — | — | — | — | — |
| 2FH21F_02_173 | — | — | — | — | — | — |
| 2FH21F_02_174 | Yes | Yes | — | — | — | — |
| 2FH21F_02_175 | Yes | — | — | — | — | — |
| 2FH21F_02_177 | — | — | — | — | — | — |
| 2FH21F_02_178 | — | — | — | — | — | — |
| 2FH21F_02_181 | — | — | — | — | — | — |
| 2FH21F_02_182 | Yes | Yes | — | — | — | — |
| 2FH21F_02_184 | — | — | — | — | — | — |
| 2FH21F_02_185 | — | — | — | — | — | — |
| 2FH21F_02_189 | — | — | — | — | — | — |
| 2FH21F_02_190 | — | — | — | — | — | — |
| 2FH21F_02_191 | — | — | — | — | — | — |
| 2FH21F_02_193 | — | — | — | — | — | — |
| 2FH21F_02_194 | — | — | — | Yes | Yes | Yes |
| 2FH21F_02_195 | — | — | — | — | — | — |
| 2FH21F_02_200 | — | — | — | — | — | — |
| 2FH21F_02_204 | Yes | Yes | Yes | — | — | — |
| 2FH21F_02_206 | — | — | — | — | — | — |
| 2FH21F_02_207 | — | — | — | — | — | — |
| 2FH21F_02_208 | Yes | — | — | Yes | Yes | Yes |
| 2FH21F_02_211 | — | — | — | — | — | — |

TABLE 13-continued

| | | | | | | |
|---|---|---|---|---|---|---|
| 2FH21F_02_212 | — | — | — | — | — | — |
| 2FH21F_02_213 | Yes | Yes | Yes | — | — | — |
| 2FH21F_02_214 | Yes | Yes | Yes | — | — | — |
| 2FH21F_02_215 | Yes | Yes | Yes | — | — | — |
| 2FH21F_02_216 | — | — | — | — | — | — |
| 2FH21F_02_217 | — | — | — | — | — | — |
| 2FH21F_02_218 | — | — | — | — | — | — |
| 2FH21F_02_219 | — | — | — | — | — | — |
| 2FH21F_02_220 | — | — | — | Yes | — | — |
| 2FH21F_02_223 | — | — | — | — | — | — |
| 2FH21F_02_226 | — | — | — | — | — | — |
| 2FH21F_02_227 | — | — | — | — | — | — |
| 2FH21F_02_228 | — | — | — | — | — | — |
| 2FH21F_02_230 | — | — | — | — | — | — |
| 2FH21F_02_232 | — | — | — | — | — | — |
| 2FH21F_02_234 | — | — | — | — | — | — |
| 2FH21F_02_235 | — | — | — | — | — | — |
| 2FH21F_02_236 | — | — | — | — | — | — |
| 2FH21F_02_239 | — | — | — | — | — | — |
| 2FH21F_02_241 | Yes | — | — | — | — | — |
| 2FH21F_02_243 | — | — | — | — | — | — |
| 2FH21F_02_248 | — | — | — | — | — | — |
| 2FH21F_02_249 | — | — | — | — | — | — |
| 2FH21F_02_250 | Yes | — | — | — | — | — |
| 2FH21F_02_254 | — | — | — | Yes | Yes | — |
| 2FH21F_03_005 | — | — | — | — | — | — |
| 2FH21F_03_007 | — | — | — | — | — | — |
| 2FH21F_03_008 | — | — | — | Yes | Yes | — |
| 2FH21F_03_011 | — | — | — | — | — | — |
| 2FH21F_03_012 | — | — | — | — | — | — |
| 2FH21F_03_013 | — | — | — | — | — | — |
| 2FH21F_03_014 | — | — | — | — | — | — |
| 2FH21F_03_015 | — | — | — | — | — | — |
| 2FH21F_03_017 | — | — | — | — | — | — |
| 2FH21F_03_018 | — | — | — | Yes | — | — |
| 2FH21F_03_021 | Yes | Yes | Yes | — | — | — |
| 2FH21F_03_022 | — | — | — | — | — | — |
| 2FH21F_03_025 | — | — | — | Yes | Yes | — |
| 2FH21F_03_026 | Yes | Yes | — | — | — | — |
| 2FH21F_03_027 | — | — | — | Yes | — | — |
| 2FH21F_03_028 | — | — | — | Yes | Yes | Yes |
| 2FH21F_03_030 | — | — | — | — | — | — |
| 2FH21F_03_031 | — | — | — | — | — | — |
| 2FH21F_03_039 | — | — | — | Yes | — | — |
| 2FH21F_03_040 | — | — | — | — | — | — |
| 2FH21F_03_043 | — | — | — | — | — | — |
| 2FH21F_03_053 | — | — | — | Yes | — | — |
| 2FH21F_03_058 | — | — | — | — | — | — |
| 2FH21F_03_061 | — | — | — | Yes | — | — |
| 2FH21F_03_062 | — | — | — | — | — | — |
| 2FH21F_03_063 | — | — | — | — | — | — |
| 2FH21F_03_064 | Yes | — | — | — | — | — |
| 2FH21F_03_065 | — | — | — | — | — | — |
| 2FH21F_03_071 | — | — | — | — | — | — |
| 2FH21F_03_073 | — | — | — | — | — | — |
| 2FH21F_03_079 | — | — | — | — | — | — |
| 2FH21F_03_080 | Yes | — | — | — | — | — |
| 2FH21F_03_081 | — | — | — | — | — | — |
| 2FH21F_03_083 | Yes | — | — | — | — | — |
| 2FH21F_03_084 | — | — | — | — | — | — |
| 2FH21F_03_085 | — | — | — | — | — | — |
| 2FH21F_03_087 | — | — | — | — | — | — |
| 2FH21F_03_088 | — | — | — | — | — | — |
| 2FH21F_03_089 | — | — | — | — | — | — |
| 2FH21F_03_091 | — | — | — | Yes | Yes | Yes |
| 2FH21F_03_093 | — | — | — | — | — | — |
| 2FH21F_03_094 | — | — | — | — | — | — |
| 2FH21F_03_095 | — | — | — | — | — | — |
| 2FH21F_03_097 | — | — | — | — | — | — |
| 2FH21F_03_098 | — | — | — | — | — | — |
| 2FH21F_03_100 | — | — | — | — | — | — |
| 2FH21F_03_101 | Yes | Yes | Yes | Yes | Yes | — |
| 2FH21F_04_006 | — | — | — | Yes | — | — |
| 2FH21F_04_008 | — | — | — | — | — | — |
| 2FH21F_04_010 | Yes | Yes | — | Yes | Yes | — |
| 2FH21F_04_011 | — | — | — | — | — | — |
| 2FH21F_04_014 | — | — | — | Yes | Yes | — |
| 2FH21F_04_015 | Yes | — | — | — | — | — |
| 2FH21F_04_017 | — | — | — | — | — | — |
| 2FH21F_04_018 | — | — | — | — | — | — |

TABLE 13-continued

| | | | | | | |
|---|---|---|---|---|---|---|
| 2FH21F_04_019 | — | — | — | — | — | — |
| 2FH21F_04_021 | Yes | Yes | Yes | Yes | Yes | — |
| 2FH21F_04_022 | Yes | Yes | Yes | Yes | Yes | Yes |
| 2FH21F_04_023 | Yes | — | — | — | — | — |
| 2FH21F_04_024 | — | — | — | — | — | — |
| 2FH21F_05_003 | — | — | — | — | — | — |
| 2FH21F_05_005 | — | — | — | — | — | — |
| 2FH21F_05_006 | — | — | — | — | — | — |
| 2FH21F_05_007 | — | — | — | — | — | — |
| 2FH21F_05_008 | — | — | — | — | — | — |
| 2FH21F_05_013 | — | — | — | — | — | — |
| 2FH21F_05_015 | — | — | — | — | — | — |
| 2FH21F_05_016 | Yes | — | — | — | — | — |
| 2FH21F_05_018 | Yes | — | — | — | — | — |
| 2FH21F_05_019 | — | — | — | Yes | Yes | Yes |
| 2FH21F_05_025 | — | — | — | — | — | — |
| 2FH21F_05_026 | — | — | — | — | — | — |
| 2FH21F_05_027 | — | — | — | — | — | — |
| 2FH21F_05_028 | — | — | — | — | — | — |
| 2FH21F_05_032 | — | — | — | — | — | — |
| 2FH21F_05_033 | — | — | — | Yes | — | — |
| 2FH21F_05_034 | — | — | — | — | — | — |
| 2FH21F_05_035 | — | — | — | Yes | Yes | — |
| 2FH21F_05_040 | — | — | — | — | — | — |
| 2FH21F_05_041 | — | — | — | Yes | Yes | Yes |
| 2FH21F_05_044 | — | — | — | — | — | — |
| 2FH21F_05_045 | — | — | — | — | — | — |
| 2FH21F_05_047 | — | — | — | Yes | — | — |
| 2FH21F_05_051 | — | — | — | — | — | — |
| 2FH21F_05_054 | — | — | — | — | — | — |
| 2FH21F_05_058 | — | — | — | — | — | — |
| 2FH21F_05_061 | — | — | — | — | — | — |
| 2FH21F_05_064 | Yes | Yes | Yes | — | — | — |
| 2FH21F_05_066 | Yes | Yes | Yes | — | — | — |
| 2FH21F_05_067 | — | — | — | — | — | — |
| 2FH21F_05_069 | — | — | — | — | — | — |
| 2FH21F_05_072 | — | — | — | — | — | — |
| 2FH21F_05_073 | — | — | — | — | — | — |
| 2FH21F_05_074 | — | — | — | — | — | — |
| 2FH21F_05_076 | — | — | — | — | — | — |
| 2FH21F_05_080 | — | — | — | — | — | — |
| 2FH21F_05_083 | — | — | — | — | — | — |
| 2FH21F_05_088 | — | — | — | — | — | — |
| 2FH21F_05_091 | — | — | — | Yes | Yes | Yes |
| 2FH21F_05_092 | — | — | — | — | — | — |
| 2FH21F_05_094 | — | — | — | Yes | Yes | — |
| 2FH21F_05_096 | Yes | Yes | Yes | Yes | — | — |
| 2FH21F_05_097 | — | — | — | Yes | — | — |
| 2FH21F_05_098 | — | — | — | — | — | — |
| 2FH21F_05_099 | — | — | — | — | — | — |
| 2FH21F_05_101 | — | — | — | — | — | — |
| 2FH21F_05_102 | Yes | — | — | — | — | — |
| 2FH21F_05_109 | Yes | — | — | — | — | — |
| 2FH21F_05_110 | — | — | — | — | — | — |
| 2FH21F_06_001 | — | — | — | — | — | — |
| 2FH21F_06_004 | — | — | — | — | — | — |
| 2FH21F_06_005 | Yes | — | — | — | — | — |
| 2FH21F_06_006 | — | — | — | — | — | — |
| 2FH21F_06_007 | Yes | — | — | Yes | Yes | Yes |
| 2FH21F_06_011 | — | — | — | — | — | — |
| 2FH21F_06_012 | — | — | — | Yes | — | — |
| 2FH21F_06_013 | — | — | — | — | — | — |
| 2FH21F_06_015 | — | — | — | — | — | — |
| 2FH21F_06_018 | — | — | — | — | — | — |
| 2FH21F_06_023 | — | — | — | — | — | — |
| 2FH21F_06_025 | — | — | — | — | — | — |
| 2FH21F_06_026 | — | — | — | Yes | — | — |
| 2FH21F_06_028 | Yes | Yes | — | — | — | — |
| 2FH21F_06_029 | — | — | — | Yes | — | — |
| 2FH21F_06_031 | — | — | — | — | — | — |
| 2FH21F_06_034 | — | — | — | — | — | — |
| 2FH21F_06_035 | — | — | — | Yes | — | — |
| 2FH21F_06_037 | — | — | — | — | — | — |
| 2FH21F_06_038 | — | — | — | — | — | — |
| 2FH21F_06_045 | — | — | — | — | — | — |
| 2FH21F_06_046 | Yes | Yes | Yes | — | — | — |
| 2FH21F_06_047 | Yes | Yes | Yes | Yes | Yes | Yes |
| 2FH21F_06_051 | — | — | — | — | — | — |
| 2FH21F_06_052 | Yes | Yes | Yes | — | — | — |
| 2FH21F_06_053 | — | — | — | — | — | — |

TABLE 13-continued

| | | | | | | |
|---|---|---|---|---|---|---|
| 2FH21F_06_060 | — | — | — | — | — | — |
| 2FH21F_06_061 | — | — | — | — | — | — |
| 2FH21F_06_062 | — | — | — | Yes | Yes | — |
| 2FH21F_06_064 | — | — | — | Yes | Yes | — |
| 2FH21F_06_065 | — | — | — | — | — | — |
| 2FH21F_06_068 | — | — | — | — | — | — |
| 2FH21F_06_073 | — | — | — | Yes | — | — |
| 2FH21F_06_075 | — | — | — | — | — | — |
| 2FH21F_06_076 | — | — | — | — | — | — |
| 2FH21F_06_077 | — | — | — | — | — | — |
| 2FH21F_06_079 | Yes | Yes | Yes | Yes | Yes | — |
| 2FH21F_06_082 | — | — | — | — | — | — |
| 2FH21F_06_083 | — | — | — | — | — | — |
| 2FH21F_06_084 | — | — | — | — | — | — |
| 2FH21F_06_088 | Yes | — | — | — | — | — |
| 2FH21F_06_092 | — | — | — | — | — | — |
| 2FH21F_06_093 | — | — | — | — | — | — |
| 2FH21F_06_095 | — | — | — | — | — | — |
| 2FH21F_06_099 | — | — | — | — | — | — |
| 2FH21F_06_102 | — | — | — | — | — | — |
| 2FH21F_06_107 | — | — | — | — | — | — |
| 2FH21F_06_110 | — | — | — | — | — | — |
| 2FH21F_06_111 | — | — | — | — | — | — |
| 2FH21F_06_112 | — | — | — | — | — | — |
| 2FH21F_06_113 | — | — | — | — | — | — |
| 2FH21F_06_114 | — | — | — | — | — | — |
| 2FH21F_06_117 | — | — | — | — | — | — |
| 2FH21F_06_118 | — | — | — | Yes | Yes | Yes |
| 2FH21F_06_119 | — | — | — | — | — | — |
| 2FH21F_06_127 | Yes | — | — | — | — | — |
| 2FH21F_06_128 | — | — | — | — | — | — |
| 2FH21F_06_129 | — | — | — | — | — | — |
| 2FH21F_06_130 | Yes | Yes | Yes | Yes | Yes | — |
| 2FH21F_06_132 | Yes | — | — | — | — | — |
| 2FH21F_06_133 | — | — | — | — | — | — |
| 2FH21F_06_134 | — | — | — | — | — | — |
| 2FH21F_06_135 | Yes | Yes | — | — | — | — |
| 2FH21F_06_137 | — | — | — | — | — | — |
| 2FH21F_06_138 | — | — | — | — | — | — |
| 2FH21F_06_140 | — | — | — | — | — | — |
| 2FH21F_06_141 | — | — | — | — | — | — |
| 2FH21F_06_142 | — | — | — | — | — | — |
| 2FH21F_06_144 | — | — | — | — | — | — |
| 2FH21F_06_147 | — | — | — | — | — | — |
| 2FH21F_06_148 | — | — | — | Yes | Yes | Yes |
| 2FH21F_06_149 | — | — | — | — | — | — |
| 2FH21F_06_150 | — | — | — | — | — | — |
| 2FH21F_06_153 | — | — | — | — | — | — |
| 2FH21F_06_155 | — | — | — | — | — | — |
| 2FH21F_06_156 | — | — | — | Yes | — | — |
| 2FH21F_06_159 | — | — | — | — | — | — |
| 2FH21F_06_163 | — | — | — | — | — | — |
| 2FH21F_06_165 | Yes | Yes | Yes | Yes | Yes | — |
| 2FH21F_06_166 | — | — | — | — | — | — |
| 2FH21F_06_168 | — | — | — | — | — | — |
| 2FH21F_06_172 | — | — | — | — | — | — |
| 2FH21F_06_176 | — | — | — | — | — | — |
| 2FH21F_06_179 | — | — | — | — | — | — |
| 2FH21F_06_182 | Yes | Yes | Yes | — | — | — |
| 2FH21F_06_183 | — | — | — | — | — | — |
| 2FH21F_06_194 | — | — | — | — | — | — |
| 2FH21F_06_196 | — | — | — | — | — | — |
| 2FH21F_06_198 | — | — | — | Yes | — | — |
| 2FH21F_06_204 | — | — | — | — | — | — |
| 2FH21F_06_218 | — | — | — | Yes | — | — |
| 2FH21F_06_219 | Yes | — | — | Yes | Yes | — |
| 2FH21F_06_224 | — | — | — | — | — | — |
| 2FH21F_06_228 | — | — | — | — | — | — |
| 2FH21F_06_229 | — | — | — | — | — | — |
| 2FH21F_06_233 | — | — | — | — | — | — |
| 2FH21F_06_238 | — | — | — | — | — | — |
| 2FH21F_06_239 | — | — | — | — | — | — |
| 2FH21F_06_241 | — | — | — | — | — | — |
| 2FH21F_06_242 | — | — | — | — | — | — |
| 2FH21F_06_243 | — | — | — | — | — | — |
| 2FH21F_06_250 | Yes | Yes | Yes | Yes | Yes | — |
| 2FH21F_06_251 | Yes | — | — | — | — | — |
| 2FH21F_06_252 | — | — | — | — | — | — |
| 2FH21F_06_253 | Yes | — | — | — | — | — |
| 2FH21F_06_254 | — | — | — | — | — | — |

TABLE 13-continued

| | | | | | | |
|---|---|---|---|---|---|---|
| 2FH21F_06_258 | Yes | Yes | Yes | — | — | — |
| 2FH21F_06_259 | — | — | — | — | — | — |
| 2FH21F_06_263 | — | — | — | Yes | Yes | Yes |
| 2FH21F_06_264 | Yes | — | — | — | — | — |
| 2FH21F_06_268 | — | — | — | — | — | — |
| 2FH21F_06_275 | — | — | — | — | — | — |
| 2FH21F_06_277 | — | — | — | — | — | — |
| 2FH21F_06_278 | — | — | — | Yes | Yes | Yes |
| 2FH21F_06_279 | — | — | — | — | — | — |
| 2FH21F_06_284 | — | — | — | — | — | — |
| 2FH21F_06_288 | — | — | — | — | — | — |
| 2FH21F_07_002 | — | — | — | — | — | — |
| 2FH21F_07_003 | Yes | Yes | — | — | — | — |
| 2FH21F_07_004 | — | — | — | — | — | — |
| 2FH21F_07_009 | — | — | — | — | — | — |
| 2FH21F_07_016 | — | — | — | — | — | — |
| 2FH21F_07_017 | — | — | — | — | — | — |
| 2FH21F_07_018 | Yes | Yes | — | — | — | — |
| 2FH21F_07_021 | — | — | — | — | — | — |
| 2FH21F_07_022 | — | — | — | — | — | — |
| 2FH21F_07_025 | — | — | — | Yes | — | — |
| 2FH21F_07_026 | — | — | — | — | — | — |
| 2FH21F_07_027 | — | — | — | — | — | — |
| 2FH21F_07_028 | — | — | — | — | — | — |
| 2FH21F_07_029 | — | — | — | — | — | — |
| 2FH21F_07_030 | — | — | — | — | — | — |
| 2FH21F_07_033 | — | — | — | — | — | — |
| 2FH21F_07_035 | — | — | — | — | — | — |
| 2FH21F_07_036 | — | — | — | — | — | — |
| 2FH21F_07_037 | — | — | — | — | — | — |
| 2FH21F_07_042 | — | — | — | — | — | — |
| 2FH21F_07_050 | — | — | — | — | — | — |
| 2FH21F_07_052 | — | — | — | — | — | — |
| 2FH21F_07_053 | — | — | — | — | — | — |
| 2FH21F_07_057 | Yes | — | — | — | — | — |
| 2FH21F_07_058 | — | — | — | — | — | — |
| 2FH21F_07_059 | Yes | — | — | Yes | Yes | — |
| 2FH21F_07_061 | Yes | — | — | — | — | — |
| 2FH21F_07_063 | — | — | — | — | — | — |
| 2FH21F_07_064 | — | — | — | Yes | Yes | — |
| 2FH21F_07_067 | — | — | — | — | — | — |
| 2FH21F_07_071 | — | — | — | — | — | — |
| 2FH21F_07_072 | — | — | — | — | — | — |
| 2FH21F_07_074 | Yes | Yes | — | — | — | — |
| 2FH21F_07_081 | — | — | — | — | — | — |
| 2FH21F_07_082 | — | — | — | — | — | — |
| 2FH21F_07_084 | — | — | — | — | — | — |
| 2FH21F_07_088 | — | — | — | — | — | — |
| 2FH21F_07_090 | Yes | — | — | — | — | — |
| 2FH21F_07_094 | — | — | — | — | — | — |
| 2FH21F_07_095 | — | — | — | Yes | — | — |
| 2FH21F_07_105 | — | — | — | — | — | — |
| 2FH21F_07_106 | — | — | — | — | — | — |
| 2FH21F_07_109 | — | — | — | — | — | — |
| 2FH21F_07_112 | — | — | — | — | — | — |
| 2FH21F_07_115 | — | — | — | — | — | — |
| 2FH21F_07_116 | — | — | — | — | — | — |
| 2FH21F_07_117 | — | — | — | — | — | — |
| 2FH21F_07_119 | — | — | — | — | — | — |
| 2FH21F_07_122 | — | — | — | — | — | — |
| 2FH21F_07_128 | — | — | — | — | — | — |
| 2FH21F_07_130 | — | — | — | — | — | — |
| 2FH21F_07_131 | — | — | — | Yes | — | — |
| 2FH21F_07_135 | Yes | — | — | — | — | — |
| 2FH21F_07_136 | — | — | — | — | — | — |
| 2FH21F_07_138 | — | — | — | — | — | — |
| 2FH21F_07_142 | — | — | — | — | — | — |
| 2FH21F_07_143 | — | — | — | — | — | — |
| 2FH21F_07_147 | — | — | — | — | — | — |
| 2FH21F_07_150 | — | — | — | Yes | — | — |
| 2FH21F_07_151 | — | — | — | — | — | — |
| 2FH21F_07_152 | — | — | — | — | — | — |
| 2FH21F_07_153 | — | — | — | — | — | — |
| 2FH21F_07_156 | — | — | — | Yes | — | — |
| 2FH21F_07_157 | — | — | — | — | — | — |
| 2FH21F_07_160 | — | — | — | Yes | — | — |
| 2FH21F_07_161 | — | — | — | — | — | — |
| 2FH21F_07_164 | — | — | — | — | — | — |
| 2FH21F_07_166 | — | — | — | Yes | Yes | Yes |
| 2FH21F_07_168 | — | — | — | — | — | — |

TABLE 13-continued

| | | | | | | |
|---|---|---|---|---|---|---|
| 2FH21F_07_176 | — | — | — | — | — | — |
| 2FH21F_07_178 | Yes | Yes | — | — | — | — |
| 2FH21F_07_179 | — | — | — | — | — | — |
| 2FH21F_07_180 | — | — | — | — | — | — |
| 2FH21F_07_181 | — | — | — | Yes | — | — |
| 2FH21F_07_183 | — | — | — | — | — | — |
| 2FH21F_07_186 | — | — | — | — | — | — |
| 2FH21F_07_187 | — | — | — | — | — | — |
| 2FH21F_07_188 | — | — | — | — | — | — |
| 2FH21F_07_194 | Yes | — | — | — | — | — |
| 2FH21F_07_195 | — | — | — | — | — | — |
| 2FH21F_07_198 | — | — | — | — | — | — |
| 2FH21F_07_200 | — | — | — | — | — | — |
| 2FH21F_07_202 | — | — | — | — | — | — |
| 2FH21F_07_203 | Yes | — | — | — | — | — |
| 2FH21F_07_207 | — | — | — | — | — | — |
| 2FH21F_07_210 | Yes | Yes | — | — | — | — |
| 2FH21F_07_211 | — | — | — | — | — | — |
| 2FH21F_07_212 | — | — | — | — | — | — |
| 2FH21F_07_214 | — | — | — | — | — | — |
| 2FH21F_07_215 | — | — | — | — | — | — |
| 2FH21F_07_216 | — | — | — | — | — | — |
| 2FH21F_07_219 | — | — | — | — | — | — |
| 2FH21F_07_220 | Yes | — | — | — | — | — |
| 2FH21F_07_223 | — | — | — | — | — | — |
| 2FH21F_07_226 | — | — | — | — | — | — |
| 2FH21F_07_228 | — | — | — | — | — | — |
| 2FH21F_07_229 | — | — | — | — | — | — |
| 2FH21F_07_230 | — | — | — | — | — | — |
| 2FH21F_07_233 | — | — | — | — | — | — |
| 2FH21F_07_234 | — | — | — | — | — | — |
| 2FH21F_07_235 | Yes | Yes | Yes | — | — | — |
| 2FH21F_07_238 | — | — | — | — | — | — |
| 2FH21F_07_239 | — | — | — | — | — | — |
| 2FH21F_07_240 | — | — | — | Yes | — | — |
| 2FH21F_07_241 | Yes | — | — | — | — | — |
| 2FH21F_07_242 | — | — | — | Yes | — | — |
| 2FH21F_07_243 | — | — | — | — | — | — |
| 2FH21F_07_245 | — | — | — | — | — | — |
| 2FH21F_07_247 | — | — | — | Yes | — | — |
| 2FH21F_07_253 | — | — | — | — | — | — |
| 2FH21F_07_254 | — | — | — | — | — | — |
| 2FH21F_07_256 | — | — | — | — | — | — |
| 2FH21F_07_262 | — | — | — | — | — | — |
| 2FH21F_07_264 | — | — | — | — | — | — |
| 2FH21F_07_268 | — | — | — | — | — | — |
| 2FH21F_07_269 | — | — | — | — | — | — |
| 2FH21F_07_270 | — | — | — | — | — | — |
| 2FH21F_07_271 | Yes | — | — | — | — | — |
| 2FH21F_07_277 | — | — | — | — | — | — |
| 2FH21F_07_279 | — | — | — | — | — | — |
| 2FH21F_07_282 | — | — | — | Yes | Yes | — |
| 2FH21F_07_283 | — | — | — | — | — | — |
| 2FH21F_07_289 | — | — | — | — | — | — |
| 2FH21F_07_293 | — | — | — | — | — | — |
| 2FH21F_07_298 | — | — | — | — | — | — |
| 2FH21F_07_302 | — | — | — | — | — | — |
| 2FH21F_07_303 | — | — | — | — | — | — |
| 2FH21F_07_304 | — | — | — | — | — | — |
| 2FH21F_07_305 | — | — | — | — | — | — |
| 2FH21F_07_306 | — | — | — | — | — | — |
| 2FH21F_07_307 | — | — | — | — | — | — |
| 2FH21F_07_308 | — | — | — | — | — | — |
| 2FH21F_07_309 | — | — | — | Yes | — | — |
| 2FH21F_07_312 | — | — | — | — | — | — |
| 2FH21F_07_321 | — | — | — | — | — | — |
| 2FH21F_07_323 | — | — | — | — | — | — |
| 2FH21F_07_325 | — | — | — | — | — | — |
| 2FH21F_07_329 | — | — | — | — | — | — |
| 2FH21F_07_331 | — | — | — | — | — | — |
| 2FH21F_07_332 | — | — | — | — | — | — |
| 2FH21F_07_333 | — | — | — | — | — | — |
| 2FH21F_07_334 | — | — | — | — | — | — |
| 2FH21F_07_335 | — | — | — | — | — | — |
| 2FH21F_07_337 | — | — | — | — | — | — |
| 2FH21F_07_340 | — | — | — | — | — | — |
| 2FH21F_07_343 | — | — | — | — | — | — |
| 2FH21F_07_347 | Yes | — | — | — | — | — |
| 2FH21F_07_349 | — | — | — | — | — | — |
| 2FH21F_07_351 | — | — | — | — | — | — |

TABLE 13-continued

| | | | | | | |
|---|---|---|---|---|---|---|
| 2FH21F_07_352 | — | — | — | — | — | — |
| 2FH21F_07_354 | — | — | — | — | — | — |
| 2FH21F_07_355 | Yes | Yes | — | — | — | — |
| 2FH21F_07_356 | — | — | — | — | — | — |
| 2FH21F_07_357 | — | — | — | — | — | — |
| 2FH21F_07_358 | — | — | — | — | — | — |
| 2FH21F_07_359 | — | — | — | — | — | — |
| 2FH21F_07_360 | — | — | — | — | — | — |
| 2FH21F_07_365 | — | — | — | — | — | — |
| 2FH21F_07_366 | — | — | — | — | — | — |
| 2FH21F_07_367 | — | — | — | Yes | — | — |
| 2FH21F_07_368 | — | — | — | Yes | — | — |
| 2FH21F_07_369 | — | — | — | — | — | — |
| 2FH21F_07_370 | Yes | — | — | — | — | — |
| 2FH21F_07_371 | — | — | — | — | — | — |
| 2FH21F_07_373 | — | — | — | — | — | — |
| 2FH21F_07_374 | — | — | — | Yes | — | — |
| 2FH21F_07_375 | — | — | — | — | — | — |
| 2FH21F_07_376 | — | — | — | — | — | — |
| 2FH21F_07_377 | — | — | — | — | — | — |
| 2FH21F_07_380 | — | — | — | — | — | — |
| 2FH21F_07_381 | — | — | — | — | — | — |
| 2FH21F_07_385 | Yes | Yes | Yes | — | — | — |
| 2FH21F_07_391 | — | — | — | — | — | — |
| 2FH21F_07_393 | Yes | Yes | — | — | — | — |
| 2FH21F_07_394 | — | — | — | Yes | — | — |
| 2FH21F_07_395 | — | — | — | Yes | — | — |
| 2FH21F_07_397 | — | — | — | Yes | — | — |
| 2FH21F_07_398 | Yes | Yes | — | Yes | — | — |
| 2FH21F_07_399 | — | — | — | Yes | — | — |
| 2FH21F_07_402 | — | — | — | Yes | — | — |
| 2FH21F_07_403 | — | — | — | — | — | — |
| 2FH21F_07_405 | — | — | — | — | — | — |
| 2FH21F_07_406 | — | — | — | Yes | — | — |
| 2FH21F_07_407 | — | — | — | — | — | — |
| 2FH21F_07_416 | Yes | — | — | — | — | — |
| 2FH21F_07_419 | — | — | — | — | — | — |
| 2FH21F_07_420 | Yes | — | — | — | — | — |
| 2FH21F_07_421 | — | — | — | — | — | — |
| 2FH21F_07_422 | — | — | — | — | — | — |
| 2FH21F_07_423 | — | — | — | — | — | — |
| 2FH21F_07_426 | — | — | — | Yes | Yes | — |
| 2FH21F_07_427 | — | — | — | — | — | — |
| 2FH21F_07_429 | — | — | — | Yes | — | — |
| 2FH21F_07_430 | — | — | — | Yes | Yes | — |
| 2FH21F_07_431 | Yes | Yes | — | — | — | — |
| 2FH21F_07_434 | — | — | — | — | — | — |
| 2FH21F_07_437 | — | — | — | — | — | — |
| 2FH21F_07_438 | Yes | Yes | — | — | — | — |
| 2FH21F_07_439 | — | — | — | — | — | — |
| 2FH21F_07_443 | — | — | — | — | — | — |
| 2FH21F_07_444 | — | — | — | — | — | — |
| 2FH21F_07_445 | — | — | — | — | — | — |
| 2FH21F_07_447 | — | — | — | — | — | — |
| 2FH21F_07_452 | — | — | — | — | — | — |
| 2FH21F_07_454 | — | — | — | — | — | — |
| 2FH21F_07_457 | — | — | — | — | — | — |
| 2FH21F_07_459 | — | — | — | — | — | — |
| 2FH21F_07_460 | — | — | — | — | — | — |
| 2FH21F_07_462 | — | — | — | — | — | — |
| 2FH21F_07_463 | — | — | — | Yes | — | — |
| 2FH21F_07_464 | — | — | — | — | — | — |
| 2FH21F_07_465 | — | — | — | — | — | — |
| 2FH21F_07_466 | — | — | — | — | — | — |
| 2FH21F_07_474 | — | — | — | — | — | — |
| 2FH21F_07_475 | — | — | — | — | — | — |
| 2FH21F_07_476 | — | — | — | — | — | — |
| 2FH21F_07_479 | — | — | — | — | — | — |
| 2FH21F_07_480 | — | — | — | — | — | — |
| 2FH21F_07_482 | — | — | — | Yes | — | — |
| 2FH21F_07_483 | — | — | — | Yes | — | — |
| 2FH21F_08_001 | — | — | — | Yes | — | — |
| 2FH21F_08_003 | Yes | — | — | Yes | — | — |
| 2FH21F_08_004 | Yes | — | — | — | — | — |
| 2FH21F_08_008 | Yes | Yes | Yes | Yes | Yes | Yes |
| 2FH21F_08_009 | Yes | Yes | Yes | — | — | — |
| 2FH21F_08_010 | — | — | — | Yes | Yes | Yes |
| 2FH21F_08_013 | — | — | — | — | — | — |
| 2FH21F_08_014 | — | — | — | — | — | — |
| 2FH21F_08_016 | — | — | — | Yes | — | — |

TABLE 13-continued

| | | | | | | |
|---|---|---|---|---|---|---|
| 2FH21F_08_017 | Yes | — | — | — | — | — |
| 2FH21F_09_004 | — | — | — | Yes | Yes | — |
| 2FH21F_09_005 | — | — | — | Yes | Yes | Yes |
| 2FH21F_09_007 | — | — | — | — | — | — |
| 2FH21F_09_010 | Yes | Yes | Yes | Yes | Yes | — |
| 2FH21F_09_013 | Yes | Yes | Yes | — | — | — |
| 2FH21F_09_016 | Yes | — | — | Yes | — | — |
| 2FH21F_09_018 | — | — | — | — | — | — |
| 2FH21F_10_003 | — | — | — | Yes | Yes | Yes |
| 2FH21F_10_005 | Yes | — | — | Yes | Yes | — |
| 2FH21F_10_006 | Yes | Yes | — | Yes | Yes | — |
| 2FH21F_10_007 | — | — | — | — | — | — |
| 2FH21F_10_011 | Yes | — | — | — | — | — |
| 2FH21F_10_016 | — | — | — | — | — | — |
| 2FH21F_10_018 | — | — | — | — | — | — |
| 2FH21F_10_019 | — | — | — | Yes | — | — |
| 2FH21F_10_020 | Yes | — | — | — | — | — |
| 2FH21F_11_001 | — | — | — | — | — | — |
| 2FH21F_11_002 | — | — | — | — | — | — |
| 2FH21F_11_003 | — | — | — | — | — | — |
| 2FH21F_11_005 | — | — | — | — | — | — |
| 2FH21F_11_006 | Yes | — | — | — | — | — |
| 2FH21F_11_007 | Yes | — | — | Yes | — | — |
| 2FH21F_11_008 | Yes | — | — | — | — | — |
| 2FH21F_11_010 | — | — | — | — | — | — |
| 2FH21F_11_012 | — | — | — | Yes | Yes | — |
| 2FH21F_11_013 | Yes | Yes | — | Yes | — | — |
| 2FH21F_11_014 | Yes | — | — | Yes | — | — |
| 2FH21F_11_015 | — | — | — | — | — | — |
| 2FH21F_11_019 | — | — | — | — | — | — |
| 2FH21F_11_020 | Yes | Yes | Yes | Yes | Yes | Yes |
| 2FH21F_11_022 | — | — | — | — | — | — |
| 2FH21F_11_023 | — | — | — | — | — | — |
| 2FH21F_11_024 | — | — | — | — | — | — |
| 2FH21F_11_026 | — | — | — | Yes | Yes | — |
| 2FH21F_11_027 | — | — | — | Yes | Yes | — |
| 2FH21F_11_028 | — | — | — | Yes | Yes | — |
| 2FH21F_11_029 | — | — | — | — | — | — |
| 2FH21F_11_030 | — | — | — | — | — | — |
| 2FH21F_11_033 | — | — | — | Yes | Yes | — |
| 2FH21F_12_003 | — | — | — | Yes | — | — |
| 2FH21F_12_011 | Yes | — | — | Yes | — | — |
| 2FH21F_12_012 | Yes | Yes | — | Yes | — | — |
| 2FH21F_12_013 | — | — | — | Yes | — | — |
| 2FH21F_12_015 | — | — | — | — | — | — |
| 2FH21F_12_016 | — | — | — | — | — | — |
| 2FH21F_12_032 | — | — | — | Yes | Yes | Yes |
| 2FH21F_12_036 | — | — | — | Yes | Yes | — |
| 2FH21F_12_039 | — | — | — | — | — | — |
| 2FH21F_12_048 | — | — | — | — | — | — |
| 2FH21F_12_049 | — | — | — | — | — | — |
| 2FH21F_12_050 | — | — | — | — | — | — |
| 2FH21F_12_051 | — | — | — | — | — | — |
| 2FH21F_12_052 | Yes | — | — | — | — | — |
| 2FH21F_12_053 | — | — | — | — | — | — |
| 2FH21F_12_054 | — | — | — | — | — | — |
| 2FH21F_12_057 | — | — | — | — | — | — |
| 2FH21F_12_058 | — | — | — | — | — | — |
| 2FH21F_12_060 | — | — | — | Yes | Yes | — |
| 2FH21F_12_064 | — | — | — | — | — | — |
| 2FH21F_12_066 | — | — | — | — | — | — |
| 2FH21F_12_068 | — | — | — | — | — | — |
| 2FH21F_12_071 | — | — | — | — | — | — |
| 2FH21F_12_072 | — | — | — | — | — | — |
| 2FH21F_12_073 | — | — | — | Yes | Yes | Yes |
| 2FH21F_12_074 | — | — | — | Yes | Yes | — |
| 2FH21F_12_075 | — | — | — | Yes | Yes | Yes |
| 2FH21F_12_076 | — | — | — | — | — | — |
| 2FH21F_12_077 | — | — | — | — | — | — |
| 2FH21F_12_078 | Yes | — | — | Yes | Yes | — |
| 2FH21F_12_079 | — | — | — | — | — | — |
| 2FH21F_12_080 | — | — | — | — | — | — |
| 2FH21F_12_081 | — | — | — | — | — | — |
| 2FH21F_12_082 | Yes | Yes | — | — | — | — |
| 2FH21F_12_083 | Yes | — | — | — | — | — |
| 2FH21F_12_084 | — | — | — | — | — | — |
| 2FH21F_12_086 | — | — | — | — | — | — |
| 2FH21F_12_088 | — | — | — | — | — | — |
| 2FH21F_12_094 | — | — | — | — | — | — |
| 2FH21F_12_095 | — | — | — | Yes | — | — |

TABLE 13-continued

| | | | | | | |
|---|---|---|---|---|---|---|
| 2FH21F_12_098 | — | — | — | — | — | — |
| 2FH21F_12_103 | — | — | — | Yes | Yes | — |
| 2FH21F_12_104 | — | — | — | — | — | — |
| 2FH21F_12_105 | — | — | — | — | — | — |
| 2FH21F_12_106 | Yes | Yes | Yes | — | — | — |
| 2FH21F_12_107 | — | — | — | — | — | — |
| 2FH21F_12_112 | — | — | — | — | — | — |
| 2FH21F_12_113 | Yes | — | — | — | — | — |
| 2FH21F_12_114 | — | — | — | — | — | — |
| 2FH21F_13_005 | — | — | — | — | — | — |
| 2FH21F_13_019 | — | — | — | — | — | — |
| 2FH21F_13_020 | — | — | — | — | — | — |
| 2FH21F_13_022 | Yes | — | — | — | — | — |
| 2FH21F_13_023 | — | — | — | — | — | — |
| 2FH21F_13_026 | — | — | — | Yes | — | — |
| 2FH21F_13_028 | — | — | — | — | — | — |
| 2FH21F_13_031 | Yes | — | — | — | — | — |
| 2FH21F_13_032 | Yes | — | — | — | — | — |
| 2FH21F_13_033 | Yes | Yes | — | — | — | — |
| 2FH21F_13_035 | — | — | — | — | — | — |
| 2FH21F_13_036 | — | — | — | — | — | — |
| 2FH21F_13_039 | — | — | — | — | — | — |
| 2FH21F_13_040 | — | — | — | — | — | — |
| 2FH21F_13_041 | — | — | — | — | — | — |
| 2FH21F_13_042 | — | — | — | — | — | — |
| 2FH21F_13_043 | — | — | — | — | — | — |
| 2FH21F_13_046 | — | — | — | — | — | — |
| 2FH21F_13_047 | — | — | — | — | — | — |
| 2FH21F_13_048 | Yes | — | — | Yes | Yes | — |
| 2FH21F_13_049 | — | — | — | — | — | — |
| 2FH21F_13_051 | Yes | — | — | Yes | Yes | — |
| 2FH21F_13_052 | — | — | — | — | — | — |
| 2FH21F_13_054 | — | — | — | — | — | — |
| 2FH21F_13_057 | Yes | Yes | — | — | — | — |
| 2FH21F_13_059 | — | — | — | — | — | — |
| 2FH21F_13_060 | — | — | — | — | — | — |
| 2FH21F_13_062 | — | — | — | — | — | — |
| 2FH21F_13_065 | — | — | — | — | — | — |
| 2FH21F_13_066 | — | — | — | — | — | — |
| 2FH21F_13_068 | — | — | — | Yes | — | — |
| 2FH21F_13_071 | — | — | — | Yes | — | — |
| 2FH21F_13_077 | — | — | — | — | — | — |
| 2FH21F_13_079 | — | — | — | — | — | — |
| 2FH21F_13_082 | — | — | — | — | — | — |
| 2FH21F_13_083 | — | — | — | — | — | — |
| 2FH21F_13_084 | — | — | — | — | — | — |
| 2FH21F_13_088 | — | — | — | — | — | — |
| 2FH21F_13_099 | — | — | — | — | — | — |
| 2FH21F_13_101 | — | — | — | Yes | Yes | Yes |
| 2FH21F_13_105 | — | — | — | — | — | — |
| 2FH21F_13_107 | — | — | — | — | — | — |
| 2FH21F_13_108 | — | — | — | — | — | — |
| 2FH21F_13_110 | Yes | — | — | Yes | Yes | — |
| 2FH21F_13_111 | — | — | — | — | — | — |
| 2FH21F_13_112 | — | — | — | — | — | — |
| 2FH21F_14_006 | — | — | — | — | — | — |
| 2FH21F_14_008 | Yes | — | — | — | — | — |
| 2FH21F_14_010 | — | — | — | — | — | — |
| 2FH21F_14_011 | — | — | — | Yes | — | — |
| 2FH21F_14_012 | Yes | Yes | — | Yes | Yes | Yes |
| 2FH21F_14_013 | — | — | — | — | — | — |
| 2FH21F_14_015 | — | — | — | — | — | — |
| 2FH21F_14_016 | Yes | — | — | — | — | — |
| 2FH21F_14_017 | — | — | — | — | — | — |
| 2FH21F_14_018 | Yes | Yes | Yes | — | — | — |
| 2FH21F_14_026 | Yes | — | — | Yes | Yes | Yes |
| 2FH21F_14_027 | — | — | — | — | — | — |
| 2FH21F_14_028 | — | — | — | — | — | — |
| 2FH21F_14_033 | — | — | — | Yes | Yes | — |
| 2FH21F_14_035 | — | — | — | — | — | — |
| 2FH21F_14_037 | — | — | — | Yes | Yes | — |
| 2FH21F_14_039 | Yes | — | — | — | — | — |
| 2FH21F_14_040 | — | — | — | — | — | — |
| 2FH21F_15_002 | — | — | — | — | — | — |
| 2FH21F_15_004 | — | — | — | — | — | — |
| 2FH21F_15_005 | — | — | — | — | — | — |
| 2FH21F_15_009 | Yes | — | — | — | — | — |
| 2FH21F_15_010 | — | — | — | — | — | — |
| 2FH21F_15_011 | — | — | — | — | — | — |
| 2FH21F_15_015 | Yes | — | — | Yes | — | — |

TABLE 13-continued

| | | | | | | |
|---|---|---|---|---|---|---|
| 2FH21F_15_016 | — | — | — | — | — | — |
| 2FH21F_15_017 | — | — | — | Yes | — | — |
| 2FH21F_15_018 | — | — | — | — | — | — |
| 2FH21F_15_019 | — | — | — | — | — | — |
| 2FH21F_15_021 | — | — | — | — | — | — |
| 2FH21F_15_024 | — | — | — | — | — | — |
| 2FH21F_15_025 | Yes | — | — | — | — | — |
| 2FH21F_15_026 | — | — | — | — | — | — |
| 2FH21F_15_027 | — | — | — | — | — | — |
| 2FH21F_15_030 | — | — | — | — | — | — |
| 2FH21F_15_031 | — | — | — | — | — | — |
| 2FH21F_15_032 | Yes | Yes | — | — | — | — |
| 2FH21F_15_033 | — | — | — | — | — | — |
| 2FH21F_15_034 | — | — | — | — | — | — |
| 2FH21F_15_038 | — | — | — | — | — | — |
| 2FH21F_15_040 | — | — | — | — | — | — |
| 2FH21F_15_041 | — | — | — | — | — | — |
| 2FH21F_15_042 | — | — | — | — | — | — |
| 2FH21F_15_043 | — | — | — | — | — | — |
| 2FH21F_15_044 | Yes | — | — | — | — | — |
| 2FH21F_15_045 | — | — | — | Yes | Yes | — |
| 2FH21F_15_046 | — | — | — | — | — | — |
| 2FH21F_15_047 | Yes | — | — | Yes | — | — |
| 2FH21F_15_048 | — | — | — | — | — | — |
| 2FH21F_15_050 | — | — | — | — | — | — |
| 2FH21F_15_054 | — | — | — | — | — | — |
| 2FH21F_15_057 | Yes | Yes | — | — | — | — |
| 2FH21F_15_061 | — | — | — | Yes | — | — |
| 2FH21F_15_068 | — | — | — | Yes | — | — |
| 2FH21F_15_069 | — | — | — | — | — | — |
| 2FH21F_15_070 | — | — | — | — | — | — |
| 2FH21F_15_074 | — | — | — | — | — | — |
| 2FH21F_15_075 | — | — | — | — | — | — |
| 2FH21F_15_076 | — | — | — | — | — | — |
| 2FH21F_15_077 | — | — | — | — | — | — |
| 2FH21F_15_079 | — | — | — | Yes | — | — |
| 2FH21F_15_082 | — | — | — | — | — | — |
| 2FH21F_15_083 | Yes | Yes | — | Yes | — | — |
| 2FH21F_15_084 | — | — | — | — | — | — |
| 2FH21F_15_085 | Yes | Yes | — | — | — | — |
| 2FH21F_15_086 | — | — | — | — | — | — |
| 2FH21F_15_091 | — | — | — | — | — | — |
| 2FH21F_15_092 | — | — | — | — | — | — |
| 2FH21F_15_093 | — | — | — | — | — | — |
| 2FH21F_15_097 | Yes | Yes | — | Yes | — | — |
| 2FH21F_15_101 | — | — | — | — | — | — |
| 2FH21F_15_103 | — | — | — | Yes | — | — |
| 2FH21F_15_106 | Yes | — | — | — | — | — |
| 2FH21F_15_107 | — | — | — | — | — | — |
| 2FH21F_15_119 | — | — | — | — | — | — |
| 2FH21F_15_126 | — | — | — | — | — | — |
| 2FH21F_15_128 | — | — | — | — | — | — |
| 2FH21F_15_130 | — | — | — | — | — | — |
| 2FH21F_15_134 | — | — | — | — | — | — |
| 2FH21F_15_135 | Yes | Yes | Yes | — | — | — |
| 2FH21F_15_137 | — | — | — | — | — | — |
| 2FH21F_15_139 | — | — | — | — | — | — |
| 2FH21F_15_142 | — | — | — | — | — | — |
| 2FH21F_15_144 | — | — | — | — | — | — |
| 2FH21F_15_146 | — | — | — | — | — | — |
| 2FH21F_15_147 | — | — | — | Yes | Yes | — |
| 2FH21F_15_148 | — | — | — | — | — | — |
| 2FH21F_15_149 | — | — | — | — | — | — |
| 2FH21F_15_150 | — | — | — | — | — | — |
| 2FH21F_15_151 | — | — | — | — | — | — |
| 2FH21F_15_152 | — | — | — | — | — | — |
| 2FH21F_15_153 | — | — | — | — | — | — |
| 2FH21F_15_156 | — | — | — | — | — | — |
| 2FH21F_15_157 | Yes | Yes | Yes | — | — | — |
| 2FH21F_15_160 | — | — | — | — | — | — |
| 2FH21F_15_165 | — | — | — | Yes | — | — |
| 2FH21F_15_170 | — | — | — | Yes | Yes | — |
| 2FH21F_15_175 | — | — | — | — | — | — |
| 2FH21F_15_178 | — | — | — | — | — | — |
| 2FH21F_15_180 | — | — | — | — | — | — |
| 2FH21F_15_182 | Yes | — | — | — | — | — |
| 2FH21F_15_191 | — | — | — | — | — | — |
| 2FH21F_15_193 | — | — | — | — | — | — |
| 2FH21F_15_195 | — | — | — | — | — | — |
| 2FH21F_15_196 | — | — | — | — | — | — |

TABLE 13-continued

| | | | | | | |
|---|---|---|---|---|---|---|
| 2FH21F_15_198 | — | — | — | — | — | — |
| 2FH21F_15_200 | — | — | — | — | — | — |
| 2FH21F_15_209 | — | — | — | — | — | — |
| 2FH21F_15_210 | — | — | — | — | — | — |
| 2FH21F_15_211 | — | — | — | — | — | — |
| 2FH21F_15_212 | — | — | — | Yes | — | — |
| 2FH21F_15_214 | — | — | — | — | — | — |
| 2FH21F_15_217 | — | — | — | — | — | — |
| 2FH21F_15_218 | — | — | — | — | — | — |
| 2FH21F_15_219 | Yes | Yes | Yes | Yes | Yes | Yes |
| 2FH21F_15_220 | — | — | — | — | — | — |
| 2FH21F_15_221 | — | — | — | — | — | — |
| 2FH21F_15_222 | — | — | — | — | — | — |
| 2FH21F_15_223 | — | — | — | — | — | — |
| 2FH21F_15_228 | — | — | — | — | — | — |
| 2FH21F_15_231 | — | — | — | — | — | — |
| 2FH21F_15_234 | — | — | — | Yes | Yes | Yes |
| 2FH21F_15_236 | Yes | Yes | Yes | — | — | — |
| 2FH21F_15_237 | Yes | — | — | — | — | — |
| 2FH21F_15_238 | Yes | — | — | — | — | — |
| 2FH21F_15_239 | — | — | — | — | — | — |
| 2FH21F_15_241 | — | — | — | Yes | Yes | — |
| 2FH21F_15_242 | Yes | Yes | Yes | — | — | — |
| 2FH21F_15_243 | — | — | — | Yes | — | — |
| 2FH21F_15_244 | — | — | — | — | — | — |
| 2FH21F_15_247 | — | — | — | — | — | — |
| 2FH21F_15_248 | — | — | — | — | — | — |
| 2FH21F_16_004 | — | — | — | — | — | — |
| 2FH21F_16_005 | Yes | — | — | Yes | Yes | — |
| 2FH21F_16_006 | — | — | — | — | — | — |
| 2FH21F_16_010 | — | — | — | — | — | — |
| 2FH21F_16_011 | — | — | — | — | — | — |
| 2FH21F_16_012 | — | — | — | — | — | — |
| 2FH21F_16_014 | Yes | — | — | — | — | — |
| 2FH21F_16_015 | — | — | — | Yes | Yes | Yes |
| 2FH21F_16_016 | Yes | — | — | — | — | — |
| 2FH21F_16_018 | — | — | — | Yes | Yes | — |
| 2FH21F_16_019 | — | — | — | — | — | — |
| 2FH21F_16_021 | — | — | — | — | — | — |
| 2FH21F_16_022 | Yes | Yes | — | — | — | — |
| 2FH21F_16_023 | Yes | — | — | Yes | Yes | Yes |
| 2FH21F_16_024 | Yes | Yes | — | Yes | — | — |
| 2FH21F_16_025 | — | — | — | — | — | — |
| 2FH21F_17_004 | — | — | — | — | — | — |
| 2FH21F_17_006 | Yes | — | — | — | — | — |
| 2FH21F_17_008 | — | — | — | Yes | — | — |
| 2FH21F_17_009 | — | — | — | — | — | — |
| 2FH21F_17_010 | — | — | — | Yes | — | — |
| 2FH21F_17_011 | Yes | Yes | — | — | — | — |
| 2FH21F_17_012 | — | — | — | Yes | — | — |
| 2FH21F_17_014 | Yes | — | — | — | — | — |
| 2FH21F_17_015 | — | — | — | — | — | — |
| 2FH21F_17_020 | — | — | — | — | — | — |
| 2FH21F_17_021 | — | — | — | — | — | — |
| 2FH21F_17_022 | Yes | — | — | Yes | — | — |
| 2FH21F_17_023 | — | — | — | Yes | Yes | — |
| 2FH21F_18_002 | — | — | — | Yes | — | — |
| 2FH21F_18_005 | — | — | — | — | — | — |
| 2FH21F_18_006 | — | — | — | — | — | — |
| 2FH21F_18_007 | — | — | — | — | — | — |
| 2FH21F_18_019 | — | — | — | Yes | — | — |
| 2FH21F_18_020 | — | — | — | — | — | — |
| 2FH21F_18_021 | — | — | — | Yes | — | — |
| 2FH21F_18_023 | — | — | — | — | — | — |
| 2FH21F_18_031 | — | — | — | — | — | — |
| 2FH21F_18_035 | — | — | — | — | — | — |
| 2FH21F_18_042 | — | — | — | Yes | — | — |
| 2FH21F_18_044 | — | — | — | — | — | — |
| 2FH21F_18_045 | — | — | — | — | — | — |
| 2FH21F_18_046 | Yes | Yes | Yes | Yes | Yes | Yes |
| 2FH21F_18_047 | — | — | — | — | — | — |
| 2FH21F_18_048 | — | — | — | — | — | — |
| 2FH21F_18_050 | — | — | — | — | — | — |
| 2FH21F_18_051 | — | — | — | — | — | — |
| 2FH21F_18_054 | — | — | — | Yes | — | — |
| 2FH21F_18_055 | — | — | — | — | — | — |
| 2FH21F_18_059 | — | — | — | — | — | — |
| 2FH21F_18_060 | Yes | Yes | — | — | — | — |
| 2FH21F_18_061 | — | — | — | — | — | — |
| 2FH21F_18_063 | — | — | — | — | — | — |

TABLE 13-continued

| | | | | | | |
|---|---|---|---|---|---|---|
| 2FH21F_18_065 | — | — | — | — | — | — |
| 2FH21F_18_066 | — | — | — | — | — | — |
| 2FH21F_18_067 | Yes | — | — | — | — | — |
| 2FH21F_18_068 | — | — | — | — | — | — |
| 2FH21F_18_070 | — | — | — | — | — | — |
| 2FH21F_18_071 | Yes | Yes | Yes | — | — | — |
| 2FH21F_18_072 | — | — | — | — | — | — |
| 2FH21F_18_074 | — | — | — | — | — | — |
| 2FH21F_18_076 | — | — | — | — | — | — |
| 2FH21F_18_078 | Yes | — | — | — | — | — |
| 2FH21F_18_083 | — | — | — | — | — | — |
| 2FH21F_18_086 | — | — | — | — | — | — |
| 2FH21F_18_090 | — | — | — | — | — | — |
| 2FH21F_18_094 | — | — | — | — | — | — |
| 2FH21F_18_101 | — | — | — | — | — | — |
| 2FH21F_18_103 | — | — | — | — | — | — |
| 2FH21F_18_117 | — | — | — | — | — | — |
| 2FH21F_18_120 | — | — | — | Yes | — | — |
| 2FH21F_18_122 | — | — | — | — | — | — |
| 2FH21F_18_123 | Yes | — | — | — | — | — |
| 2FH21F_18_126 | Yes | — | — | — | — | — |
| 2FH21F_18_127 | — | — | — | — | — | — |
| 2FH21F_18_132 | — | — | — | — | — | — |
| 2FH21F_18_133 | — | — | — | — | — | — |
| 2FH21F_18_136 | — | — | — | Yes | — | — |
| 2FH21F_18_137 | — | — | — | — | — | — |
| 2FH21F_18_138 | — | — | — | — | — | — |
| 2FH21F_18_139 | Yes | — | — | Yes | — | — |
| 2FH21F_18_141 | — | — | — | Yes | — | — |
| 2FH21F_18_142 | — | — | — | — | — | — |
| 2FH21F_18_143 | — | — | — | — | — | — |
| 2FH21F_18_144 | Yes | — | — | — | — | — |
| 2FH21F_18_145 | Yes | Yes | Yes | Yes | Yes | Yes |
| 2FH21F_18_149 | Yes | Yes | Yes | Yes | Yes | Yes |
| 2FH21F_18_151 | — | — | — | — | — | — |
| 2FH21F_18_153 | — | — | — | — | — | — |
| 2FH21F_18_154 | — | — | — | — | — | — |
| 2FH21F_18_156 | — | — | — | — | — | — |
| 2FH21F_18_158 | — | — | — | — | — | — |
| 2FH21F_18_159 | — | — | — | — | — | — |
| 2FH21F_18_160 | — | — | — | — | — | — |
| 2FH21F_18_161 | Yes | Yes | — | — | — | — |
| 2FH21F_18_162 | — | — | — | — | — | — |
| 2FH21F_18_171 | — | — | — | — | — | — |
| 2FH21F_18_172 | — | — | — | — | — | — |
| 2FH21F_18_173 | — | — | — | — | — | — |
| 2FH21F_18_174 | — | — | — | — | — | — |
| 2FH21F_18_175 | — | — | — | — | — | — |
| 2FH21F_18_176 | — | — | — | — | — | — |
| 2FH21F_18_178 | Yes | — | — | — | — | — |
| 2FH21F_18_186 | — | — | — | — | — | — |
| 2FH21F_18_188 | — | — | — | — | — | — |
| 2FH21F_18_190 | — | — | — | Yes | — | — |
| 2FH21F_18_191 | Yes | — | — | — | — | — |
| 2FH21F_18_194 | — | — | — | — | — | — |
| 2FH21F_18_195 | — | — | — | Yes | — | — |
| 2FH21F_18_197 | — | — | — | — | — | — |
| 2FH21F_18_198 | Yes | — | — | Yes | Yes | — |
| 2FH21F_18_199 | — | — | — | — | — | — |
| 2FH21F_18_200 | — | — | — | — | — | — |
| 2FH21F_18_201 | — | — | — | — | — | — |
| 2FH21F_18_202 | — | — | — | — | — | — |
| 2FH21F_18_203 | — | — | — | Yes | — | — |
| 2FH21F_18_204 | Yes | — | — | — | — | — |
| 2FH21F_18_212 | — | — | — | — | — | — |
| 2FH21F_18_213 | — | — | — | — | — | — |
| 2FH21F_18_216 | — | — | — | — | — | — |
| 2FH21F_18_217 | — | — | — | — | — | — |
| 2FH21F_18_219 | Yes | — | — | — | — | — |
| 2FH21F_18_223 | — | — | — | — | — | — |
| 2FH21F_18_224 | — | — | — | — | — | — |
| 2FH21F_18_226 | — | — | — | — | — | — |
| 2FH21F_18_233 | Yes | Yes | Yes | — | — | — |
| 2FH21F_18_234 | — | — | — | — | — | — |
| 2FH21F_18_241 | — | — | — | — | — | — |
| 2FH21F_18_243 | — | — | — | Yes | Yes | — |
| 2FH21F_18_244 | Yes | — | — | — | — | — |
| 2FH21F_18_245 | — | — | — | — | — | — |
| 2FH21F_18_252 | — | — | — | Yes | — | — |
| 2FH21F_18_254 | — | — | — | — | — | — |

TABLE 13-continued

| | | | | | | |
|---|---|---|---|---|---|---|
| 2FH21F_18_255 | — | — | — | — | — | — |
| 2FH21F_18_260 | — | — | — | — | — | — |
| 2FH21F_18_261 | — | — | — | — | — | — |
| 2FH21F_18_262 | — | — | — | — | — | — |
| 2FH21F_18_268 | — | — | — | — | — | — |
| 2FH21F_18_269 | — | — | — | Yes | — | — |
| 2FH21F_18_270 | — | — | — | — | — | — |
| 2FH21F_18_271 | — | — | — | — | — | — |
| 2FH21F_18_272 | — | — | — | — | — | — |
| 2FH21F_18_273 | — | — | — | — | — | — |
| 2FH21F_18_274 | — | — | — | — | — | — |
| 2FH21F_18_275 | Yes | — | — | — | — | — |
| 2FH21F_18_276 | — | — | — | Yes | — | — |
| 2FH21F_18_277 | — | — | — | — | — | — |
| 2FH21F_18_284 | — | — | — | — | — | — |
| 2FH21F_18_292 | — | — | — | — | — | — |
| 2FH21F_18_293 | — | — | — | — | — | — |
| 2FH21F_18_296 | — | — | — | Yes | Yes | Yes |
| 2FH21F_18_300 | — | — | — | — | — | — |
| 2FH21F_18_301 | — | — | — | — | — | — |
| 2FH21F_18_303 | — | — | — | Yes | — | — |
| 2FH21F_18_304 | — | — | — | — | — | — |
| 2FH21F_18_305 | — | — | — | — | — | — |
| 2FH21F_18_307 | — | — | — | Yes | — | — |
| 2FH21F_18_314 | Yes | Yes | — | Yes | — | — |
| 2FH21F_18_319 | — | — | — | — | — | — |
| 2FH21F_18_326 | — | — | — | — | — | — |
| 2FH21F_18_327 | — | — | — | — | — | — |
| 2FH21F_18_328 | — | — | — | — | — | — |
| 2FH21F_18_329 | Yes | — | — | — | — | — |
| 2FH21F_18_330 | — | — | — | — | — | — |
| 2FH21F_18_332 | — | — | — | Yes | Yes | Yes |
| 2FH21F_18_333 | — | — | — | — | — | — |
| 2FH21F_18_340 | — | — | — | — | — | — |
| 2FH21F_18_344 | — | — | — | — | — | — |
| 2FH21F_18_346 | — | — | — | — | — | — |
| 2FH21F_18_349 | Yes | — | — | — | — | — |
| 2FH21F_18_350 | Yes | — | — | — | — | — |
| 2FH21F_18_351 | — | — | — | Yes | Yes | — |
| 2FH21F_18_352 | — | — | — | — | — | — |
| 2FH21F_18_354 | — | — | — | — | — | — |
| 2FH21F_18_355 | — | — | — | — | — | — |
| 2FH21F_18_357 | — | — | — | — | — | — |
| 2FH21F_18_364 | — | — | — | — | — | — |
| 2FH21F_18_365 | — | — | — | — | — | — |
| 2FH21F_18_369 | — | — | — | Yes | Yes | — |
| 2FH21F_18_370 | — | — | — | — | — | — |
| 2FH21F_18_375 | — | — | — | — | — | — |
| 2FH21F_18_380 | — | — | — | Yes | Yes | Yes |
| 2FH21F_18_386 | Yes | Yes | — | — | — | — |
| 2FH21F_18_388 | — | — | — | — | — | — |
| 2FH21F_18_398 | — | — | — | — | — | — |
| 2FH21F_18_399 | — | — | — | — | — | — |
| 2FH21F_18_402 | — | — | — | — | — | — |
| 2FH21F_18_403 | — | — | — | — | — | — |
| 2FH21F_18_405 | — | — | — | — | — | — |
| 2FH21F_18_408 | — | — | — | — | — | — |
| 2FH21F_18_409 | — | — | — | — | — | — |
| 2FH21F_18_412 | — | — | — | — | — | — |
| 2FH21F_18_414 | — | — | — | — | — | — |
| 2FH21F_18_415 | — | — | — | — | — | — |
| 2FH21F_18_417 | — | — | — | Yes | — | — |
| 2FH21F_18_419 | — | — | — | — | — | — |
| 2FH21F_18_427 | — | — | — | — | — | — |
| 2FH21F_18_428 | — | — | — | — | — | — |
| 2FH21F_18_429 | — | — | — | — | — | — |
| 2FH21F_18_430 | — | — | — | — | — | — |
| 2FH21F_18_432 | — | — | — | — | — | — |
| 2FH21F_18_434 | — | — | — | — | — | — |
| 2FH21F_18_435 | — | — | — | — | — | — |
| 2FH21F_18_441 | — | — | — | — | — | — |
| 2FH21F_18_446 | — | — | — | — | — | — |
| 2FH21F_18_457 | — | — | — | — | — | — |
| 2FH21F_18_459 | — | — | — | — | — | — |
| 2FH21F_18_460 | — | — | — | — | — | — |
| 2FH21F_18_461 | — | — | — | — | — | — |
| 2FH21F_18_462 | — | — | — | Yes | Yes | — |
| 2FH21F_18_463 | — | — | — | Yes | — | — |
| 2FH21F_18_466 | — | — | — | — | — | — |
| 2FH21F_18_467 | — | — | — | — | — | — |

TABLE 13-continued

| | | | | | | |
|---|---|---|---|---|---|---|
| 2FH21F_18_468 | Yes | Yes | Yes | — | — | — |
| 2FH21F_18_469 | — | — | — | — | — | — |
| 2FH21F_18_470 | — | — | — | — | — | — |
| 2FH21F_18_472 | — | — | — | Yes | Yes | Yes |
| 2FH21F_18_474 | — | — | — | — | — | — |
| 2FH21F_18_475 | — | — | — | Yes | Yes | — |
| 2FH21F_18_476 | — | — | — | — | — | — |
| 2FH21F_18_480 | — | — | — | Yes | Yes | Yes |
| 2FH21F_18_481 | Yes | — | — | — | — | — |
| 2FH21F_18_482 | — | — | — | Yes | — | — |
| 2FH21F_18_483 | Yes | Yes | Yes | — | — | — |
| 2FH21F_18_485 | — | — | — | — | — | — |
| 2FH21F_18_490 | — | — | — | — | — | — |
| 2FH21F_18_491 | — | — | — | Yes | — | — |
| 2FH21F_18_494 | — | — | — | — | — | — |
| 2FH21F_18_497 | — | — | — | — | — | — |
| 2FH21F_18_501 | — | — | — | — | — | — |
| 2FH21F_18_502 | — | — | — | — | — | — |
| 2FH21F_18_503 | — | — | — | — | — | — |
| 2FH21F_18_504 | — | — | — | — | — | — |
| 2FH21F_18_505 | — | — | — | — | — | — |
| 2FH21F_18_506 | — | — | — | — | — | — |
| 2FH21F_18_508 | — | — | — | — | — | — |
| 2FH21F_18_509 | — | — | — | — | — | — |
| 2FH21F_18_510 | — | — | — | — | — | — |
| 2FH21F_18_511 | — | — | — | Yes | Yes | Yes |
| 2FH21F_18_512 | — | — | — | — | — | — |
| 2FH21F_18_513 | Yes | Yes | — | — | — | — |
| 2FH21F_18_515 | — | — | — | — | — | — |
| 2FH21F_18_516 | — | — | — | — | — | — |
| 2FH21F_18_517 | — | — | — | — | — | — |
| 2FH21F_18_518 | — | — | — | — | — | — |
| 2FH21F_18_519 | — | — | — | — | — | — |
| 2FH21F_18_520 | — | — | — | — | — | — |
| 2FH21F_18_521 | — | — | — | — | — | — |
| 2FH21F_18_522 | — | — | — | Yes | Yes | — |
| 2FH21F_18_523 | Yes | — | — | Yes | Yes | Yes |
| 2FH21F_18_524 | — | — | — | — | — | — |
| 2FH21F_18_525 | — | — | — | — | — | — |
| 2FH21F_18_526 | — | — | — | — | — | — |
| 2FH21F_18_527 | — | — | — | — | — | — |
| 2FH21F_18_529 | Yes | — | — | Yes | Yes | Yes |
| 2FH21F_18_530 | — | — | — | — | — | — |
| 2FH21F_18_534 | — | — | — | — | — | — |
| 2FH21F_18_535 | — | — | — | — | — | — |
| 2FH21F_18_536 | Yes | — | — | — | — | — |
| 2FH21F_18_537 | — | — | — | Yes | Yes | Yes |
| 2FH21F_18_538 | — | — | — | Yes | — | — |
| 2FH21F_18_539 | Yes | — | — | — | — | — |
| 2FH21F_18_543 | — | — | — | Yes | — | — |
| 2FH21F_18_545 | — | — | — | — | — | — |
| 2FH21F_18_548 | — | — | — | — | — | — |
| 2FH21F_18_549 | — | — | — | — | — | — |
| 2FH21F_18_555 | — | — | — | — | — | — |
| 2FH21F_18_565 | — | — | — | — | — | — |
| 2FH21F_18_566 | — | — | — | — | — | — |
| 2FH21F_18_567 | — | — | — | — | — | — |
| 2FH21F_18_570 | — | — | — | — | — | — |
| 2FH21F_18_571 | — | — | — | — | — | — |
| 2FH21F_18_574 | — | — | — | — | — | — |
| 2FH21F_18_576 | Yes | — | — | — | — | — |
| 2FH21F_18_577 | — | — | — | — | — | — |
| 2FH21F_18_579 | — | — | — | — | — | — |
| 2FH21F_18_583 | — | — | — | — | — | — |
| 2FH21F_18_585 | — | — | — | — | — | — |
| 2FH21F_18_590 | — | — | — | — | — | — |
| 2FH21F_18_594 | — | — | — | — | — | — |
| 2FH21F_19_004 | — | — | — | — | — | — |
| 2FH21F_19_005 | Yes | — | — | Yes | — | — |
| 2FH21F_19_006 | — | — | — | — | — | — |
| 2FH21F_19_007 | Yes | — | — | Yes | — | — |
| 2FH21F_19_010 | Yes | Yes | — | Yes | Yes | — |
| 2FH21F_19_012 | — | — | — | Yes | — | — |
| 2FH21F_19_014 | — | — | — | Yes | Yes | Yes |
| 2FH21F_19_015 | — | — | — | — | — | — |
| 2FH21F_19_016 | — | — | — | — | — | — |
| 2FH21F_19_018 | — | — | — | — | — | — |
| 2FH21F_19_022 | Yes | — | — | — | — | — |
| 2FH21F_19_026 | — | — | — | — | — | — |
| 2FH21F_19_027 | — | — | — | — | — | — |

TABLE 13-continued

| Marker_ID | | | | | | |
|---|---|---|---|---|---|---|
| 2FH21F_19_028 | — | — | — | — | — | — |
| 2FH21F_19_030 | — | — | — | — | — | — |
| 2FH21F_19_031 | Yes | Yes | Yes | — | — | — |
| 2FH21F_20_003 | — | — | — | — | — | — |
| 2FH21F_20_004 | Yes | — | — | Yes | — | — |
| 2FH21F_20_006 | — | — | — | — | — | — |
| 2FH21F_20_007 | Yes | — | — | — | — | — |
| 2FH21F_20_008 | — | — | — | — | — | — |
| 2FH21F_20_009 | Yes | — | — | Yes | — | — |
| 2FH21F_20_010 | — | — | — | Yes | — | — |
| 2FH21F_20_011 | — | — | — | — | — | — |
| 2FH21F_20_012 | — | — | — | Yes | — | — |
| 2FH21F_20_013 | Yes | Yes | Yes | Yes | — | — |
| 2FH21F_20_014 | — | — | — | — | — | — |
| 2FH21F_20_015 | — | — | — | — | — | — |
| 2FH21F_20_016 | Yes | — | — | — | — | — |
| 2FH21F_20_017 | — | — | — | Yes | — | — |
| 2FH21F_20_018 | — | — | — | — | — | — |
| 2FH21F_20_020 | — | — | — | — | — | — |
| 2FH21F_22_012 | — | — | — | — | — | — |
| 2FH21F_22_016 | — | — | — | — | — | — |
| 2FH21F_22_017 | — | — | — | — | — | — |
| 2FH21F_22_018 | — | — | — | — | — | — |
| 2FH21F_22_019 | — | — | — | — | — | — |
| 2FH21F_22_021 | Yes | Yes | — | — | — | — |
| 2FH21F_22_025 | Yes | — | — | — | — | — |
| 2FH21F_22_026 | — | — | — | — | — | — |
| 2FH21F_22_028 | Yes | — | — | — | — | — |
| 2FH21F_22_029 | — | — | — | — | — | — |
| 2FH21F_22_030 | — | — | — | — | — | — |
| 2FH21F_22_035 | — | — | — | — | — | — |
| 2FH21F_22_036 | — | — | — | Yes | — | — |
| 2FH21F_22_037 | — | — | — | Yes | — | — |
| 2FH21F_22_040 | — | — | — | — | — | — |
| 2FH21F_22_042 | — | — | — | — | — | — |
| 2FH21F_22_043 | — | — | — | — | — | — |
| 2FH21F_22_044 | — | — | — | — | — | — |
| 2FH21F_22_047 | — | — | — | — | — | — |
| 2FH21F_22_048 | — | — | — | — | — | — |
| 2FH21F_22_051 | — | — | — | — | — | — |
| 2FH21F_22_055 | — | — | — | — | — | — |
| 2FH21F_22_056 | — | — | — | — | — | — |
| 2FH21F_22_057 | — | — | — | Yes | — | — |
| 2FH21F_22_059 | — | — | — | — | — | — |
| 2FH21F_22_061 | — | — | — | — | — | — |
| 2FH21F_22_062 | — | — | — | — | — | — |
| 2FH21F_22_067 | — | — | — | — | — | — |
| 2FH21F_22_068 | Yes | — | — | Yes | — | — |
| 2FH21F_22_073 | Yes | — | — | — | — | — |
| 2FH21F_22_074 | Yes | — | — | Yes | — | — |
| 2FH21F_22_075 | — | — | — | — | — | — |
| 2FH21F_22_076 | Yes | — | — | — | — | — |
| 2FH21F_22_077 | — | — | — | — | — | — |
| 2FH21F_22_078 | — | — | — | — | — | — |
| 2FH21F_22_079 | — | — | — | Yes | Yes | — |
| 2FH21F_22_080 | Yes | — | — | Yes | — | — |
| 2FH21F_22_081 | — | — | — | Yes | — | — |
| 2FH21F_22_082 | — | — | — | — | — | — |
| 2FH21F_22_085 | — | — | — | Yes | — | — |

| | Experiment 3 | | | |
|---|---|---|---|---|
| Marker_ID | Full_Screen_All_1004 tier 1 DNA set 1 | Full_Screen_ReplexI_236 tier 2 DNA set 1, 3 | Full_Screen_Replex2_92 tier 3 1, 3 | Full_Screen_Plasma56 tier 4* 1, 3 |
| 2FH21F_01_003 | Yes | — | — | — |
| 2FH21F_01_006 | Yes | — | — | — |
| 2FH21F_01_007 | — | — | — | — |
| 2FH21F_01_009 | Yes | — | — | — |
| 2FH21F_01_010 | Yes | — | — | — |
| 2FH21F_01_011 | Yes | — | — | — |
| 2FH21F_01_012 | Yes | — | — | — |
| 2FH21F_01_013 | — | — | — | — |
| 2FH21F_01_014 | Yes | — | — | — |
| 2FH21F_01_015 | — | — | — | — |
| 2FH21F_01_017 | Yes | — | — | — |
| 2FH21F_01_018 | Yes | — | — | — |
| 2FH21F_01_020 | Yes | — | — | — |

TABLE 13-continued

| | | | | |
|---|---|---|---|---|
| 2FH21F_01_021 | Yes | — | — | — |
| 2FH21F_01_022 | Yes | — | — | — |
| 2FH21F_01_023 | Yes | — | — | — |
| 2FH21F_01_025 | Yes | — | — | — |
| 2FH21F_01_026 | — | — | — | — |
| 2FH21F_01_027 | Yes | — | — | — |
| 2FH21F_01_029 | Yes | — | — | — |
| 2FH21F_01_030 | Yes | Yes | Yes | Yes |
| 2FH21F_01_031 | Yes | Yes | — | — |
| 2FH21F_01_033 | Yes | Yes | Yes | — |
| 2FH21F_01_034 | Yes | — | — | — |
| 2FH21F_01_036 | — | — | — | — |
| 2FH21F_01_037 | — | — | — | — |
| 2FH21F_01_038 | Yes | — | — | — |
| 2FH21F_01_039 | Yes | — | — | — |
| 2FH21F_01_040 | — | — | — | — |
| 2FH21F_01_041 | Yes | Yes | Yes | Yes |
| 2FH21F_01_043 | Yes | — | — | — |
| 2FH21F_01_044 | Yes | — | — | — |
| 2FH21F_01_045 | Yes | — | — | — |
| 2FH21F_01_046 | — | — | — | — |
| 2FH21F_01_049 | — | — | — | — |
| 2FH21F_01_050 | Yes | — | — | — |
| 2FH21F_01_057 | — | — | — | — |
| 2FH21F_01_058 | Yes | — | — | — |
| 2FH21F_01_059 | Yes | — | — | — |
| 2FH21F_01_060 | Yes | — | — | — |
| 2FH21F_01_062 | Yes | — | — | — |
| 2FH21F_01_063 | Yes | — | — | — |
| 2FH21F_01_064 | Yes | — | — | — |
| 2FH21F_01_065 | Yes | — | — | — |
| 2FH21F_01_067 | Yes | — | — | — |
| 2FH21F_01_068 | Yes | — | — | — |
| 2FH21F_01_071 | — | — | — | — |
| 2FH21F_01_072 | Yes | — | — | — |
| 2FH21F_01_073 | Yes | — | — | — |
| 2FH21F_01_077 | Yes | — | — | — |
| 2FH21F_01_078 | Yes | — | — | — |
| 2FH21F_01_080 | Yes | — | — | — |
| 2FH21F_01_081 | Yes | — | — | — |
| 2FH21F_01_082 | Yes | — | — | — |
| 2FH21F_01_083 | — | — | — | — |
| 2FH21F_01_084 | Yes | — | — | — |
| 2FH21F_01_086 | Yes | — | — | — |
| 2FH21F_01_088 | Yes | — | — | — |
| 2FH21F_01_090 | — | — | — | — |
| 2FH21F_01_093 | Yes | — | — | — |
| 2FH21F_01_094 | — | — | — | — |
| 2FH21F_01_099 | Yes | — | — | — |
| 2FH21F_01_101 | Yes | — | — | — |
| 2FH21F_01_102 | Yes | — | — | — |
| 2FH21F_01_104 | Yes | — | — | — |
| 2FH21F_02_003 | Yes | Yes | — | — |
| 2FH21F_02_007 | — | Yes | — | — |
| 2FH21F_02_015 | — | — | — | — |
| 2FH21F_02_017 | — | — | — | — |
| 2FH21F_02_018 | Yes | — | — | — |
| 2FH21F_02_019 | Yes | — | — | — |
| 2FH21F_02_020 | Yes | — | — | — |
| 2FH21F_02_021 | Yes | — | — | — |
| 2FH21F_02_022 | — | — | — | Yes |
| 2FH21F_02_023 | Yes | — | — | — |
| 2FH21F_02_027 | Yes | — | — | — |
| 2FH21F_02_034 | Yes | — | — | — |
| 2FH21F_02_035 | — | — | — | — |
| 2FH21F_02_036 | Yes | — | — | — |
| 2FH21F_02_037 | — | — | — | — |
| 2FH21F_02_038 | Yes | — | — | — |
| 2FH21F_02_040 | Yes | — | — | — |
| 2FH21F_02_041 | Yes | — | — | — |
| 2FH21F_02_043 | Yes | — | — | — |
| 2FH21F_02_045 | Yes | — | — | — |
| 2FH21F_02_050 | Yes | Yes | — | — |
| 2FH21F_02_055 | — | Yes | — | — |
| 2FH21F_02_057 | Yes | — | — | — |
| 2FH21F_02_058 | Yes | — | — | — |
| 2FH21F_02_061 | — | — | — | — |
| 2FH21F_02_062 | Yes | — | — | — |
| 2FH21F_02_063 | — | — | — | — |
| 2FH21F_02_065 | Yes | — | — | — |

TABLE 13-continued

| | | | | |
|---|---|---|---|---|
| 2FH21F_02_066 | Yes | — | — | — |
| 2FH21F_02_067 | Yes | — | — | — |
| 2FH21F_02_072 | Yes | — | — | — |
| 2FH21F_02_073 | Yes | — | — | — |
| 2FH21F_02_074 | Yes | Yes | Yes | — |
| 2FH21F_02_075 | Yes | Yes | Yes | Yes |
| 2FH21F_02_076 | Yes | — | Yes | Yes |
| 2FH21F_02_077 | — | — | — | — |
| 2FH21F_02_088 | — | — | — | — |
| 2FH21F_02_089 | — | Yes | Yes | Yes |
| 2FH21F_02_090 | Yes | — | — | — |
| 2FH21F_02_091 | Yes | Yes | Yes | Yes |
| 2FH21F_02_103 | Yes | — | — | — |
| 2FH21F_02_107 | Yes | Yes | Yes | Yes |
| 2FH21F_02_108 | Yes | — | — | — |
| 2FH21F_02_111 | Yes | Yes | Yes | Yes |
| 2FH21F_02_113 | — | — | — | — |
| 2FH21F_02_116 | — | Yes | Yes | Yes |
| 2FH21F_02_127 | Yes | — | — | — |
| 2FH21F_02_129 | Yes | — | — | — |
| 2FH21F_02_132 | Yes | — | — | — |
| 2FH21F_02_134 | Yes | — | — | — |
| 2FH21F_02_139 | Yes | — | — | — |
| 2FH21F_02_143 | Yes | — | — | — |
| 2FH21F_02_144 | Yes | — | — | — |
| 2FH21F_02_145 | Yes | — | — | — |
| 2FH21F_02_146 | Yes | — | — | — |
| 2FH21F_02_148 | Yes | Yes | Yes | Yes |
| 2FH21F_02_150 | — | — | — | — |
| 2FH21F_02_151 | Yes | — | — | — |
| 2FH21F_02_155 | Yes | — | — | — |
| 2FH21F_02_156 | Yes | — | — | — |
| 2FH21F_02_157 | Yes | — | — | — |
| 2FH21F_02_158 | Yes | — | — | — |
| 2FH21F_02_159 | Yes | — | — | — |
| 2FH21F_02_163 | Yes | — | — | — |
| 2FH21F_02_168 | Yes | — | — | — |
| 2FH21F_02_170 | — | — | — | — |
| 2FH21F_02_172 | Yes | — | — | — |
| 2FH21F_02_173 | Yes | — | — | — |
| 2FH21F_02_174 | Yes | — | — | — |
| 2FH21F_02_175 | Yes | — | — | — |
| 2FH21F_02_177 | Yes | — | — | — |
| 2FH21F_02_178 | Yes | — | — | — |
| 2FH21F_02_181 | Yes | — | — | — |
| 2FH21F_02_182 | Yes | — | — | — |
| 2FH21F_02_184 | Yes | — | — | — |
| 2FH21F_02_185 | Yes | — | — | — |
| 2FH21F_02_189 | Yes | — | — | — |
| 2FH21F_02_190 | Yes | — | — | — |
| 2FH21F_02_191 | Yes | — | — | — |
| 2FH21F_02_193 | Yes | — | — | — |
| 2FH21F_02_194 | — | — | — | — |
| 2FH21F_02_195 | Yes | — | — | — |
| 2FH21F_02_200 | Yes | — | — | — |
| 2FH21F_02_204 | Yes | — | — | — |
| 2FH21F_02_206 | Yes | — | — | — |
| 2FH21F_02_207 | Yes | — | — | — |
| 2FH21F_02_208 | — | — | — | — |
| 2FH21F_02_211 | Yes | — | — | — |
| 2FH21F_02_212 | Yes | — | — | — |
| 2FH21F_02_213 | Yes | — | — | — |
| 2FH21F_02_214 | Yes | — | — | — |
| 2FH21F_02_215 | Yes | — | — | — |
| 2FH21F_02_216 | Yes | — | — | — |
| 2FH21F_02_217 | Yes | — | — | — |
| 2FH21F_02_218 | Yes | — | — | — |
| 2FH21F_02_219 | Yes | — | — | — |
| 2FH21F_02_220 | — | — | — | — |
| 2FH21F_02_223 | Yes | — | — | — |
| 2FH21F_02_226 | Yes | — | — | — |
| 2FH21F_02_227 | Yes | — | — | — |
| 2FH21F_02_228 | Yes | Yes | — | — |
| 2FH21F_02_230 | Yes | — | — | — |
| 2FH21F_02_232 | Yes | — | — | — |
| 2FH21F_02_234 | Yes | — | — | — |
| 2FH21F_02_235 | Yes | — | — | — |
| 2FH21F_02_236 | Yes | — | — | — |
| 2FH21F_02_239 | Yes | — | — | — |
| 2FH21F_02_241 | Yes | Yes | — | — |

TABLE 13-continued

| | | | | |
|---|---|---|---|---|
| 2FH21F_02_243 | Yes | Yes | — | — |
| 2FH21F_02_248 | Yes | — | — | — |
| 2FH21F_02_249 | Yes | — | — | — |
| 2FH21F_02_250 | Yes | — | — | — |
| 2FH21F_02_254 | — | Yes | Yes | Yes |
| 2FH21F_03_005 | Yes | Yes | Yes | Yes |
| 2FH21F_03_007 | Yes | Yes | — | — |
| 2FH21F_03_008 | — | Yes | — | — |
| 2FH21F_03_011 | Yes | — | — | — |
| 2FH21F_03_012 | Yes | — | — | — |
| 2FH21F_03_013 | Yes | — | — | — |
| 2FH21F_03_014 | Yes | Yes | — | — |
| 2FH21F_03_015 | Yes | Yes | — | — |
| 2FH21F_03_017 | Yes | — | — | — |
| 2FH21F_03_018 | — | — | — | — |
| 2FH21F_03_021 | Yes | Yes | — | — |
| 2FH21F_03_022 | Yes | Yes | Yes | Yes |
| 2FH21F_03_025 | — | — | — | — |
| 2FH21F_03_026 | Yes | Yes | — | — |
| 2FH21F_03_027 | — | — | — | — |
| 2FH21F_03_028 | — | Yes | — | — |
| 2FH21F_03_030 | Yes | — | — | — |
| 2FH21F_03_031 | Yes | — | — | — |
| 2FH21F_03_039 | — | — | — | — |
| 2FH21F_03_040 | Yes | — | — | — |
| 2FH21F_03_043 | Yes | — | — | — |
| 2FH21F_03_053 | — | — | — | — |
| 2FH21F_03_058 | Yes | — | — | — |
| 2FH21F_03_061 | — | — | — | — |
| 2FH21F_03_062 | Yes | — | — | — |
| 2FH21F_03_063 | Yes | — | — | — |
| 2FH21F_03_064 | Yes | — | — | — |
| 2FH21F_03_065 | Yes | — | — | — |
| 2FH21F_03_071 | Yes | — | — | — |
| 2FH21F_03_073 | Yes | — | — | — |
| 2FH21F_03_079 | Yes | — | — | — |
| 2FH21F_03_080 | Yes | — | — | — |
| 2FH21F_03_081 | Yes | — | — | — |
| 2FH21F_03_083 | Yes | — | — | — |
| 2FH21F_03_084 | Yes | — | — | — |
| 2FH21F_03_085 | Yes | — | — | — |
| 2FH21F_03_087 | Yes | — | — | — |
| 2FH21F_03_088 | Yes | — | — | — |
| 2FH21F_03_089 | Yes | — | — | — |
| 2FH21F_03_091 | — | — | — | — |
| 2FH21F_03_093 | Yes | — | — | — |
| 2FH21F_03_094 | Yes | — | — | — |
| 2FH21F_03_095 | Yes | — | — | — |
| 2FH21F_03_097 | Yes | — | — | — |
| 2FH21F_03_098 | Yes | — | — | — |
| 2FH21F_03_100 | Yes | — | — | — |
| 2FH21F_03_101 | — | Yes | — | — |
| 2FH21F_04_006 | — | — | — | — |
| 2FH21F_04_008 | Yes | — | — | — |
| 2FH21F_04_010 | — | — | — | — |
| 2FH21F_04_011 | Yes | — | — | — |
| 2FH21F_04_014 | — | — | — | — |
| 2FH21F_04_015 | Yes | — | — | — |
| 2FH21F_04_017 | Yes | — | — | — |
| 2FH21F_04_018 | Yes | Yes | — | — |
| 2FH21F_04_019 | Yes | — | — | — |
| 2FH21F_04_021 | — | Yes | — | — |
| 2FH21F_04_022 | — | — | — | — |
| 2FH21F_04_023 | Yes | — | — | — |
| 2FH21F_04_024 | Yes | — | — | — |
| 2FH21F_05_003 | Yes | Yes | Yes | Yes |
| 2FH21F_05_005 | Yes | Yes | — | — |
| 2FH21F_05_006 | Yes | — | Yes | Yes |
| 2FH21F_05_007 | Yes | — | — | — |
| 2FH21F_05_008 | Yes | Yes | Yes | — |
| 2FH21F_05_013 | Yes | — | Yes | — |
| 2FH21F_05_015 | Yes | — | — | — |
| 2FH21F_05_016 | Yes | Yes | — | — |
| 2FH21F_05_018 | Yes | Yes | — | — |
| 2FH21F_05_019 | — | — | — | — |
| 2FH21F_05_025 | Yes | Yes | — | — |
| 2FH21F_05_026 | Yes | — | — | — |
| 2FH21F_05_027 | Yes | — | Yes | Yes |
| 2FH21F_05_028 | Yes | Yes | Yes | — |
| 2FH21F_05_032 | Yes | Yes | — | — |

TABLE 13-continued

| | | | | |
|---|---|---|---|---|
| 2FH21F_05_033 | — | Yes | Yes | Yes |
| 2FH21F_05_034 | Yes | — | — | — |
| 2FH21F_05_035 | — | — | — | — |
| 2FH21F_05_040 | Yes | — | — | — |
| 2FH21F_05_041 | — | Yes | — | — |
| 2FH21F_05_044 | Yes | — | — | — |
| 2FH21F_05_045 | Yes | Yes | — | — |
| 2FH21F_05_047 | — | — | — | — |
| 2FH21F_05_051 | Yes | — | — | — |
| 2FH21F_05_054 | Yes | — | — | — |
| 2FH21F_05_058 | Yes | Yes | — | — |
| 2FH21F_05_061 | Yes | Yes | Yes | Yes |
| 2FH21F_05_064 | Yes | Yes | — | — |
| 2FH21F_05_066 | Yes | — | — | — |
| 2FH21F_05_067 | Yes | — | — | — |
| 2FH21F_05_069 | Yes | — | — | — |
| 2FH21F_05_072 | Yes | Yes | — | — |
| 2FH21F_05_073 | Yes | — | — | — |
| 2FH21F_05_074 | Yes | — | — | — |
| 2FH21F_05_076 | Yes | — | — | — |
| 2FH21F_05_080 | Yes | — | — | — |
| 2FH21F_05_083 | Yes | Yes | — | — |
| 2FH21F_05_088 | Yes | — | — | — |
| 2FH21F_05_091 | — | Yes | Yes | — |
| 2FH21F_05_092 | Yes | — | — | — |
| 2FH21F_05_094 | — | — | — | — |
| 2FH21F_05_096 | — | — | — | — |
| 2FH21F_05_097 | — | — | — | — |
| 2FH21F_05_098 | Yes | — | — | — |
| 2FH21F_05_099 | Yes | — | — | — |
| 2FH21F_05_101 | Yes | — | — | — |
| 2FH21F_05_102 | Yes | — | — | — |
| 2FH21F_05_109 | Yes | — | — | — |
| 2FH21F_05_110 | Yes | — | — | — |
| 2FH21F_06_001 | Yes | Yes | — | — |
| 2FH21F_06_004 | Yes | — | — | — |
| 2FH21F_06_005 | Yes | — | — | — |
| 2FH21F_06_006 | Yes | — | — | — |
| 2FH21F_06_007 | — | — | — | — |
| 2FH21F_06_011 | Yes | — | — | — |
| 2FH21F_06_012 | — | — | — | — |
| 2FH21F_06_013 | Yes | — | — | — |
| 2FH21F_06_015 | Yes | — | — | — |
| 2FH21F_06_018 | Yes | — | — | — |
| 2FH21F_06_023 | Yes | — | — | — |
| 2FH21F_06_025 | Yes | — | — | — |
| 2FH21F_06_026 | — | — | — | — |
| 2FH21F_06_028 | Yes | — | — | — |
| 2FH21F_06_029 | — | — | — | — |
| 2FH21F_06_031 | Yes | — | — | — |
| 2FH21F_06_034 | Yes | — | — | — |
| 2FH21F_06_035 | — | — | — | — |
| 2FH21F_06_037 | Yes | — | — | — |
| 2FH21F_06_038 | Yes | — | — | — |
| 2FH21F_06_045 | Yes | Yes | — | — |
| 2FH21F_06_046 | Yes | — | — | — |
| 2FH21F_06_047 | — | Yes | — | — |
| 2FH21F_06_051 | Yes | Yes | Yes | — |
| 2FH21F_06_052 | Yes | — | — | — |
| 2FH21F_06_053 | Yes | Yes | Yes | — |
| 2FH21F_06_060 | Yes | — | — | — |
| 2FH21F_06_061 | Yes | — | — | — |
| 2FH21F_06_062 | — | Yes | — | — |
| 2FH21F_06_064 | — | — | — | — |
| 2FH21F_06_065 | Yes | — | — | — |
| 2FH21F_06_068 | Yes | — | — | — |
| 2FH21F_06_073 | — | Yes | — | — |
| 2FH21F_06_075 | Yes | — | — | — |
| 2FH21F_06_076 | Yes | — | — | — |
| 2FH21F_06_077 | Yes | Yes | — | — |
| 2FH21F_06_079 | — | — | — | — |
| 2FH21F_06_082 | Yes | — | — | — |
| 2FH21F_06_083 | Yes | — | — | — |
| 2FH21F_06_084 | Yes | Yes | — | — |
| 2FH21F_06_088 | Yes | — | — | — |
| 2FH21F_06_092 | Yes | Yes | Yes | — |
| 2FH21F_06_093 | Yes | Yes | — | — |
| 2FH21F_06_095 | Yes | — | — | — |
| 2FH21F_06_099 | Yes | Yes | — | — |
| 2FH21F_06_102 | Yes | — | — | — |

TABLE 13-continued

| | | | | |
|---|---|---|---|---|
| 2FH21F_06_107 | Yes | — | — | — |
| 2FH21F_06_110 | Yes | Yes | — | — |
| 2FH21F_06_111 | Yes | — | — | — |
| 2FH21F_06_112 | Yes | — | — | — |
| 2FH21F_06_113 | Yes | Yes | — | — |
| 2FH21F_06_114 | Yes | Yes | Yes | Yes |
| 2FH21F_06_117 | Yes | — | — | — |
| 2FH21F_06_118 | — | Yes | — | — |
| 2FH21F_06_119 | Yes | — | — | — |
| 2FH21F_06_127 | Yes | — | — | — |
| 2FH21F_06_128 | Yes | Yes | — | — |
| 2FH21F_06_129 | Yes | Yes | — | — |
| 2FH21F_06_130 | — | Yes | — | — |
| 2FH21F_06_132 | Yes | — | — | — |
| 2FH21F_06_133 | Yes | — | — | — |
| 2FH21F_06_134 | Yes | — | — | — |
| 2FH21F_06_135 | Yes | — | — | — |
| 2FH21F_06_137 | Yes | — | — | — |
| 2FH21F_06_138 | Yes | — | — | — |
| 2FH21F_06_140 | Yes | — | — | — |
| 2FH21F_06_141 | Yes | Yes | Yes | — |
| 2FH21F_06_142 | Yes | — | — | — |
| 2FH21F_06_144 | Yes | Yes | — | — |
| 2FH21F_06_147 | Yes | — | — | — |
| 2FH21F_06_148 | — | Yes | — | — |
| 2FH21F_06_149 | Yes | Yes | — | — |
| 2FH21F_06_150 | Yes | — | — | — |
| 2FH21F_06_153 | Yes | — | — | — |
| 2FH21F_06_155 | Yes | — | — | — |
| 2FH21F_06_156 | — | Yes | — | — |
| 2FH21F_06_159 | Yes | Yes | — | — |
| 2FH21F_06_163 | Yes | — | — | — |
| 2FH21F_06_165 | — | Yes | Yes | Yes |
| 2FH21F_06_166 | Yes | — | — | — |
| 2FH21F_06_168 | Yes | — | — | — |
| 2FH21F_06_172 | Yes | Yes | — | — |
| 2FH21F_06_176 | Yes | — | — | — |
| 2FH21F_06_179 | Yes | — | — | — |
| 2FH21F_06_182 | Yes | Yes | — | — |
| 2FH21F_06_183 | Yes | — | — | — |
| 2FH21F_06_194 | Yes | Yes | — | — |
| 2FH21F_06_196 | Yes | — | — | — |
| 2FH21F_06_198 | — | — | — | — |
| 2FH21F_06_204 | Yes | — | — | — |
| 2FH21F_06_218 | — | Yes | Yes | Yes |
| 2FH21F_06_219 | — | Yes | Yes | Yes |
| 2FH21F_06_224 | Yes | Yes | Yes | Yes |
| 2FH21F_06_228 | Yes | Yes | — | — |
| 2FH21F_06_229 | Yes | — | — | — |
| 2FH21F_06_233 | Yes | — | — | — |
| 2FH21F_06_238 | Yes | — | Yes | Yes |
| 2FH21F_06_239 | Yes | Yes | — | — |
| 2FH21F_06_241 | Yes | Yes | — | — |
| 2FH21F_06_242 | Yes | — | — | — |
| 2FH21F_06_243 | Yes | — | — | — |
| 2FH21F_06_250 | — | — | — | — |
| 2FH21F_06_251 | Yes | — | — | — |
| 2FH21F_06_252 | Yes | — | — | — |
| 2FH21F_06_253 | Yes | — | — | — |
| 2FH21F_06_254 | Yes | — | — | — |
| 2FH21F_06_258 | Yes | — | — | — |
| 2FH21F_06_259 | Yes | Yes | — | — |
| 2FH21F_06_263 | — | — | — | — |
| 2FH21F_06_264 | Yes | — | — | — |
| 2FH21F_06_268 | Yes | — | — | — |
| 2FH21F_06_275 | Yes | — | — | — |
| 2FH21F_06_277 | Yes | — | — | — |
| 2FH21F_06_278 | — | — | Yes | — |
| 2FH21F_06_279 | Yes | Yes | — | — |
| 2FH21F_06_284 | Yes | — | — | — |
| 2FH21F_06_288 | Yes | — | — | — |
| 2FH21F_07_002 | Yes | — | — | — |
| 2FH21F_07_003 | Yes | — | — | — |
| 2FH21F_07_004 | Yes | — | — | — |
| 2FH21F_07_009 | Yes | — | — | — |
| 2FH21F_07_016 | Yes | — | — | — |
| 2FH21F_07_017 | Yes | — | — | — |
| 2FH21F_07_018 | Yes | — | — | — |
| 2FH21F_07_021 | Yes | — | — | — |
| 2FH21F_07_022 | Yes | — | — | — |

TABLE 13-continued

| | | | | |
|---|---|---|---|---|
| 2FH21F_07_025 | — | — | — | — |
| 2FH21F_07_026 | Yes | — | — | — |
| 2FH21F_07_027 | Yes | — | — | — |
| 2FH21F_07_028 | Yes | — | — | — |
| 2FH21F_07_029 | Yes | — | — | — |
| 2FH21F_07_030 | Yes | — | — | — |
| 2FH21F_07_033 | Yes | — | — | — |
| 2FH21F_07_035 | Yes | — | — | — |
| 2FH21F_07_036 | Yes | — | — | — |
| 2FH21F_07_037 | Yes | — | — | — |
| 2FH21F_07_042 | Yes | — | — | — |
| 2FH21F_07_050 | Yes | — | — | — |
| 2FH21F_07_052 | Yes | — | — | — |
| 2FH21F_07_053 | Yes | — | — | — |
| 2FH21F_07_057 | Yes | — | — | — |
| 2FH21F_07_058 | Yes | — | — | — |
| 2FH21F_07_059 | — | — | — | — |
| 2FH21F_07_061 | Yes | — | — | — |
| 2FH21F_07_063 | Yes | — | — | — |
| 2FH21F_07_064 | — | — | — | — |
| 2FH21F_07_067 | Yes | — | — | — |
| 2FH21F_07_071 | Yes | Yes | Yes | Yes |
| 2FH21F_07_072 | Yes | — | — | — |
| 2FH21F_07_074 | Yes | — | — | — |
| 2FH21F_07_081 | Yes | — | — | — |
| 2FH21F_07_082 | Yes | — | — | — |
| 2FH21F_07_084 | Yes | — | — | — |
| 2FH21F_07_088 | Yes | — | — | — |
| 2FH21F_07_090 | Yes | — | — | — |
| 2FH21F_07_094 | Yes | — | — | — |
| 2FH21F_07_095 | — | — | — | — |
| 2FH21F_07_105 | Yes | — | — | — |
| 2FH21F_07_106 | Yes | — | — | — |
| 2FH21F_07_109 | Yes | — | — | — |
| 2FH21F_07_112 | Yes | — | — | — |
| 2FH21F_07_115 | Yes | — | — | — |
| 2FH21F_07_116 | Yes | — | — | — |
| 2FH21F_07_117 | Yes | — | — | — |
| 2FH21F_07_119 | Yes | — | — | — |
| 2FH21F_07_122 | Yes | — | — | — |
| 2FH21F_07_128 | Yes | — | — | — |
| 2FH21F_07_130 | Yes | — | — | — |
| 2FH21F_07_131 | — | — | — | — |
| 2FH21F_07_135 | Yes | — | — | — |
| 2FH21F_07_136 | Yes | — | — | — |
| 2FH21F_07_138 | Yes | — | — | — |
| 2FH21F_07_142 | Yes | — | — | — |
| 2FH21F_07_143 | Yes | — | — | — |
| 2FH21F_07_147 | Yes | — | — | — |
| 2FH21F_07_150 | — | — | — | — |
| 2FH21F_07_151 | Yes | — | — | — |
| 2FH21F_07_152 | Yes | — | — | — |
| 2FH21F_07_153 | Yes | — | — | — |
| 2FH21F_07_156 | — | — | — | — |
| 2FH21F_07_157 | Yes | — | — | — |
| 2FH21F_07_160 | — | — | — | — |
| 2FH21F_07_161 | Yes | — | — | — |
| 2FH21F_07_164 | Yes | — | — | — |
| 2FH21F_07_166 | — | Yes | Yes | Yes |
| 2FH21F_07_168 | Yes | — | — | — |
| 2FH21F_07_176 | Yes | — | — | — |
| 2FH21F_07_178 | Yes | — | — | — |
| 2FH21F_07_179 | Yes | — | — | — |
| 2FH21F_07_180 | Yes | — | — | — |
| 2FH21F_07_181 | — | — | — | — |
| 2FH21F_07_183 | Yes | Yes | — | — |
| 2FH21F_07_186 | Yes | Yes | — | — |
| 2FH21F_07_187 | Yes | — | — | — |
| 2FH21F_07_188 | Yes | — | — | — |
| 2FH21F_07_194 | Yes | — | — | — |
| 2FH21F_07_195 | Yes | — | — | — |
| 2FH21F_07_198 | Yes | — | — | — |
| 2FH21F_07_200 | Yes | — | — | — |
| 2FH21F_07_202 | Yes | Yes | Yes | Yes |
| 2FH21F_07_203 | Yes | — | — | — |
| 2FH21F_07_207 | Yes | — | — | — |
| 2FH21F_07_210 | Yes | — | — | — |
| 2FH21F_07_211 | Yes | — | — | — |
| 2FH21F_07_212 | Yes | — | — | — |
| 2FH21F_07_214 | Yes | — | — | — |

TABLE 13-continued

| | | | | |
|---|---|---|---|---|
| 2FH21F_07_215 | Yes | — | — | — |
| 2FH21F_07_216 | Yes | — | — | — |
| 2FH21F_07_219 | Yes | — | — | — |
| 2FH21F_07_220 | Yes | — | — | — |
| 2FH21F_07_223 | Yes | — | — | — |
| 2FH21F_07_226 | Yes | — | — | — |
| 2FH21F_07_228 | Yes | Yes | — | — |
| 2FH21F_07_229 | Yes | Yes | Yes | — |
| 2FH21F_07_230 | Yes | — | — | — |
| 2FH21F_07_233 | Yes | — | — | — |
| 2FH21F_07_234 | Yes | — | — | — |
| 2FH21F_07_235 | Yes | — | — | — |
| 2FH21F_07_238 | Yes | Yes | — | — |
| 2FH21F_07_239 | Yes | — | — | — |
| 2FH21F_07_240 | — | — | — | — |
| 2FH21F_07_241 | Yes | — | — | — |
| 2FH21F_07_242 | — | Yes | Yes | — |
| 2FH21F_07_243 | Yes | — | — | — |
| 2FH21F_07_245 | Yes | — | — | — |
| 2FH21F_07_247 | — | — | — | — |
| 2FH21F_07_253 | Yes | — | — | — |
| 2FH21F_07_254 | Yes | Yes | — | — |
| 2FH21F_07_256 | Yes | — | — | — |
| 2FH21F_07_262 | Yes | — | — | — |
| 2FH21F_07_264 | Yes | — | — | — |
| 2FH21F_07_268 | Yes | Yes | Yes | — |
| 2FH21F_07_269 | Yes | — | — | — |
| 2FH21F_07_270 | Yes | — | — | — |
| 2FH21F_07_271 | Yes | — | — | — |
| 2FH21F_07_277 | Yes | — | — | — |
| 2FH21F_07_279 | Yes | — | — | — |
| 2FH21F_07_282 | — | — | — | — |
| 2FH21F_07_283 | Yes | — | — | — |
| 2FH21F_07_289 | Yes | — | — | — |
| 2FH21F_07_293 | Yes | — | — | — |
| 2FH21F_07_298 | Yes | — | — | — |
| 2FH21F_07_302 | Yes | — | — | — |
| 2FH21F_07_303 | Yes | — | — | — |
| 2FH21F_07_304 | Yes | — | — | — |
| 2FH21F_07_305 | Yes | — | — | — |
| 2FH21F_07_306 | Yes | — | — | — |
| 2FH21F_07_307 | Yes | — | — | — |
| 2FH21F_07_308 | Yes | — | — | — |
| 2FH21F_07_309 | — | — | — | — |
| 2FH21F_07_312 | Yes | — | — | — |
| 2FH21F_07_321 | Yes | — | — | — |
| 2FH21F_07_323 | Yes | — | — | — |
| 2FH21F_07_325 | Yes | — | — | — |
| 2FH21F_07_329 | Yes | — | — | — |
| 2FH21F_07_331 | Yes | Yes | — | — |
| 2FH21F_07_332 | Yes | — | — | — |
| 2FH21F_07_333 | Yes | — | — | — |
| 2FH21F_07_334 | Yes | — | — | — |
| 2FH21F_07_335 | Yes | — | — | — |
| 2FH21F_07_337 | Yes | — | — | — |
| 2FH21F_07_340 | Yes | — | — | — |
| 2FH21F_07_343 | Yes | — | — | — |
| 2FH21F_07_347 | Yes | — | — | — |
| 2FH21F_07_349 | Yes | — | — | — |
| 2FH21F_07_351 | Yes | — | — | — |
| 2FH21F_07_352 | Yes | — | — | — |
| 2FH21F_07_354 | Yes | — | — | — |
| 2FH21F_07_355 | Yes | — | — | — |
| 2FH21F_07_356 | Yes | — | — | — |
| 2FH21F_07_357 | Yes | — | — | — |
| 2FH21F_07_358 | Yes | — | — | — |
| 2FH21F_07_359 | Yes | — | — | — |
| 2FH21F_07_360 | Yes | — | — | — |
| 2FH21F_07_365 | Yes | — | — | — |
| 2FH21F_07_366 | Yes | — | — | — |
| 2FH21F_07_367 | — | — | — | — |
| 2FH21F_07_368 | — | — | — | — |
| 2FH21F_07_369 | Yes | — | — | — |
| 2FH21F_07_370 | Yes | — | — | — |
| 2FH21F_07_371 | Yes | — | — | — |
| 2FH21F_07_373 | Yes | — | — | — |
| 2FH21F_07_374 | — | — | — | — |
| 2FH21F_07_375 | Yes | — | — | — |
| 2FH21F_07_376 | Yes | — | — | — |
| 2FH21F_07_377 | Yes | — | — | — |

TABLE 13-continued

| | | | | |
|---|---|---|---|---|
| 2FH21F_07_380 | Yes | — | — | — |
| 2FH21F_07_381 | Yes | — | — | — |
| 2FH21F_07_385 | Yes | — | — | — |
| 2FH21F_07_391 | Yes | — | — | — |
| 2FH21F_07_393 | Yes | — | — | — |
| 2FH21F_07_394 | — | — | — | — |
| 2FH21F_07_395 | — | — | — | — |
| 2FH21F_07_397 | — | — | — | — |
| 2FH21F_07_398 | — | — | — | — |
| 2FH21F_07_399 | — | — | — | — |
| 2FH21F_07_402 | — | — | — | — |
| 2FH21F_07_403 | Yes | — | — | — |
| 2FH21F_07_405 | Yes | — | — | — |
| 2FH21F_07_406 | — | — | — | — |
| 2FH21F_07_407 | Yes | Yes | — | — |
| 2FH21F_07_416 | Yes | — | — | — |
| 2FH21F_07_419 | Yes | — | — | — |
| 2FH21F_07_420 | Yes | Yes | — | — |
| 2FH21F_07_421 | Yes | Yes | — | — |
| 2FH21F_07_422 | Yes | — | — | — |
| 2FH21F_07_423 | Yes | — | — | — |
| 2FH21F_07_426 | — | — | — | — |
| 2FH21F_07_427 | Yes | — | — | — |
| 2FH21F_07_429 | — | — | — | — |
| 2FH21F_07_430 | — | — | — | — |
| 2FH21F_07_431 | Yes | — | — | — |
| 2FH21F_07_434 | Yes | — | — | — |
| 2FH21F_07_437 | Yes | — | — | — |
| 2FH21F_07_438 | Yes | — | — | — |
| 2FH21F_07_439 | Yes | — | — | — |
| 2FH21F_07_443 | Yes | — | — | — |
| 2FH21F_07_444 | Yes | — | — | — |
| 2FH21F_07_445 | Yes | — | — | — |
| 2FH21F_07_447 | Yes | — | — | — |
| 2FH21F_07_452 | Yes | — | — | — |
| 2FH21F_07_454 | Yes | — | — | — |
| 2FH21F_07_457 | Yes | — | — | — |
| 2FH21F_07_459 | Yes | — | — | — |
| 2FH21F_07_460 | Yes | — | — | — |
| 2FH21F_07_462 | Yes | Yes | — | — |
| 2FH21F_07_463 | — | — | — | — |
| 2FH21F_07_464 | Yes | Yes | Yes | Yes |
| 2FH21F_07_465 | Yes | Yes | Yes | Yes |
| 2FH21F_07_466 | Yes | — | — | — |
| 2FH21F_07_474 | Yes | — | — | — |
| 2FH21F_07_475 | Yes | — | — | — |
| 2FH21F_07_476 | Yes | — | — | — |
| 2FH21F_07_479 | Yes | — | — | — |
| 2FH21F_07_480 | Yes | — | — | — |
| 2FH21F_07_482 | — | — | — | — |
| 2FH21F_07_483 | — | — | — | — |
| 2FH21F_08_001 | — | — | — | — |
| 2FH21F_08_003 | — | — | — | — |
| 2FH21F_08_004 | Yes | Yes | — | — |
| 2FH21F_08_008 | — | — | — | — |
| 2FH21F_08_009 | Yes | — | — | — |
| 2FH21F_08_010 | — | Yes | — | — |
| 2FH21F_08_013 | Yes | — | — | — |
| 2FH21F_08_014 | Yes | — | — | — |
| 2FH21F_08_016 | — | — | — | — |
| 2FH21F_08_017 | Yes | — | — | — |
| 2FH21F_09_004 | — | — | Yes | — |
| 2FH21F_09_005 | — | Yes | — | — |
| 2FH21F_09_007 | Yes | Yes | Yes | Yes |
| 2FH21F_09_010 | — | Yes | Yes | Yes |
| 2FH21F_09_013 | Yes | — | — | — |
| 2FH21F_09_016 | — | — | — | — |
| 2FH21F_09_018 | Yes | — | — | — |
| 2FH21F_10_003 | — | — | — | — |
| 2FH21F_10_005 | — | Yes | Yes | Yes |
| 2FH21F_10_006 | — | — | — | — |
| 2FH21F_10_007 | Yes | — | — | — |
| 2FH21F_10_011 | Yes | — | — | — |
| 2FH21F_10_016 | Yes | — | — | — |
| 2FH21F_10_018 | Yes | Yes | — | — |
| 2FH21F_10_019 | — | Yes | — | — |
| 2FH21F_10_020 | Yes | — | — | — |
| 2FH21F_11_001 | Yes | — | — | — |
| 2FH21F_11_002 | Yes | — | — | — |
| 2FH21F_11_003 | Yes | — | — | — |

TABLE 13-continued

| | | | | |
|---|---|---|---|---|
| 2FH21F_11_005 | Yes | — | — | — |
| 2FH21F_11_006 | Yes | — | — | — |
| 2FH21F_11_007 | — | — | — | — |
| 2FH21F_11_008 | Yes | — | — | — |
| 2FH21F_11_010 | Yes | — | — | — |
| 2FH21F_11_012 | — | — | — | — |
| 2FH21F_11_013 | — | — | — | — |
| 2FH21F_11_014 | — | — | — | — |
| 2FH21F_11_015 | Yes | — | — | — |
| 2FH21F_11_019 | Yes | — | — | — |
| 2FH21F_11_020 | — | — | — | — |
| 2FH21F_11_022 | Yes | Yes | Yes | Yes |
| 2FH21F_11_023 | Yes | — | — | — |
| 2FH21F_11_024 | Yes | Yes | — | — |
| 2FH21F_11_026 | — | — | — | — |
| 2FH21F_11_027 | — | Yes | Yes | — |
| 2FH21F_11_028 | — | Yes | Yes | Yes |
| 2FH21F_11_029 | Yes | — | — | — |
| 2FH21F_11_030 | Yes | — | — | — |
| 2FH21F_11_033 | — | — | — | — |
| 2FH21F_12_003 | — | — | — | — |
| 2FH21F_12_011 | — | Yes | — | — |
| 2FH21F_12_012 | — | — | — | — |
| 2FH21F_12_013 | — | — | — | — |
| 2FH21F_12_015 | Yes | — | — | — |
| 2FH21F_12_016 | Yes | — | — | — |
| 2FH21F_12_032 | — | Yes | — | — |
| 2FH21F_12_036 | — | Yes | — | — |
| 2FH21F_12_039 | Yes | — | — | — |
| 2FH21F_12_048 | Yes | — | — | — |
| 2FH21F_12_049 | Yes | Yes | Yes | Yes |
| 2FH21F_12_050 | Yes | — | — | — |
| 2FH21F_12_051 | Yes | Yes | Yes | — |
| 2FH21F_12_052 | Yes | Yes | Yes | Yes |
| 2FH21F_12_053 | Yes | Yes | Yes | — |
| 2FH21F_12_054 | Yes | Yes | — | — |
| 2FH21F_12_057 | Yes | — | — | — |
| 2FH21F_12_058 | Yes | — | — | — |
| 2FH21F_12_060 | — | Yes | — | — |
| 2FH21F_12_064 | Yes | — | — | — |
| 2FH21F_12_066 | Yes | — | — | — |
| 2FH21F_12_068 | Yes | — | — | — |
| 2FH21F_12_071 | Yes | — | — | — |
| 2FH21F_12_072 | Yes | Yes | — | — |
| 2FH21F_12_073 | — | — | — | — |
| 2FH21F_12_074 | — | Yes | Yes | Yes |
| 2FH21F_12_075 | — | Yes | Yes | Yes |
| 2FH21F_12_076 | Yes | Yes | — | — |
| 2FH21F_12_077 | Yes | — | — | — |
| 2FH21F_12_078 | — | Yes | — | — |
| 2FH21F_12_079 | Yes | — | — | — |
| 2FH21F_12_080 | Yes | — | — | — |
| 2FH21F_12_081 | Yes | — | — | — |
| 2FH21F_12_082 | Yes | — | — | — |
| 2FH21F_12_083 | Yes | — | — | — |
| 2FH21F_12_084 | Yes | — | — | — |
| 2FH21F_12_086 | Yes | — | Yes | — |
| 2FH21F_12_088 | Yes | — | — | — |
| 2FH21F_12_094 | Yes | Yes | — | — |
| 2FH21F_12_095 | — | — | — | — |
| 2FH21F_12_098 | Yes | — | — | — |
| 2FH21F_12_103 | — | — | — | — |
| 2FH21F_12_104 | Yes | — | — | — |
| 2FH21F_12_105 | Yes | — | — | — |
| 2FH21F_12_106 | Yes | — | — | — |
| 2FH21F_12_107 | Yes | — | — | — |
| 2FH21F_12_112 | Yes | — | — | — |
| 2FH21F_12_113 | Yes | — | — | — |
| 2FH21F_12_114 | Yes | — | — | — |
| 2FH21F_13_005 | Yes | Yes | — | — |
| 2FH21F_13_019 | Yes | — | — | — |
| 2FH21F_13_020 | Yes | — | — | — |
| 2FH21F_13_022 | Yes | — | — | — |
| 2FH21F_13_023 | Yes | — | — | — |
| 2FH21F_13_026 | — | — | — | — |
| 2FH21F_13_028 | Yes | — | — | — |
| 2FH21F_13_031 | Yes | — | — | — |
| 2FH21F_13_032 | Yes | — | — | — |
| 2FH21F_13_033 | Yes | — | — | — |
| 2FH21F_13_035 | Yes | — | — | — |

TABLE 13-continued

| | | | | |
|---|---|---|---|---|
| 2FH21F_13_036 | Yes | Yes | Yes | Yes |
| 2FH21F_13_039 | Yes | — | — | — |
| 2FH21F_13_040 | Yes | — | — | — |
| 2FH21F_13_041 | Yes | Yes | Yes | Yes |
| 2FH21F_13_042 | Yes | — | — | — |
| 2FH21F_13_043 | Yes | — | — | — |
| 2FH21F_13_046 | Yes | — | — | — |
| 2FH21F_13_047 | Yes | — | — | — |
| 2FH21F_13_048 | — | — | — | — |
| 2FH21F_13_049 | Yes | — | — | — |
| 2FH21F_13_051 | — | — | — | — |
| 2FH21F_13_052 | Yes | — | — | — |
| 2FH21F_13_054 | Yes | Yes | — | — |
| 2FH21F_13_057 | Yes | — | — | — |
| 2FH21F_13_059 | Yes | — | — | — |
| 2FH21F_13_060 | Yes | — | — | — |
| 2FH21F_13_062 | Yes | — | — | — |
| 2FH21F_13_065 | Yes | — | — | — |
| 2FH21F_13_066 | Yes | — | — | — |
| 2FH21F_13_068 | — | — | — | — |
| 2FH21F_13_071 | — | — | — | — |
| 2FH21F_13_077 | Yes | — | — | — |
| 2FH21F_13_079 | Yes | Yes | — | — |
| 2FH21F_13_082 | Yes | — | — | — |
| 2FH21F_13_083 | Yes | — | — | — |
| 2FH21F_13_084 | Yes | — | — | — |
| 2FH21F_13_088 | Yes | — | — | — |
| 2FH21F_13_099 | Yes | — | — | — |
| 2FH21F_13_101 | — | — | — | — |
| 2FH21F_13_105 | Yes | — | — | — |
| 2FH21F_13_107 | Yes | — | — | — |
| 2FH21F_13_108 | Yes | — | — | — |
| 2FH21F_13_110 | — | — | — | — |
| 2FH21F_13_111 | Yes | — | — | — |
| 2FH21F_13_112 | Yes | — | — | — |
| 2FH21F_14_006 | Yes | — | — | — |
| 2FH21F_14_008 | Yes | — | — | — |
| 2FH21F_14_010 | Yes | — | — | — |
| 2FH21F_14_011 | — | — | — | — |
| 2FH21F_14_012 | — | — | — | — |
| 2FH21F_14_013 | Yes | — | — | — |
| 2FH21F_14_015 | Yes | — | — | — |
| 2FH21F_14_016 | Yes | — | — | — |
| 2FH21F_14_017 | Yes | — | — | — |
| 2FH21F_14_018 | Yes | — | — | — |
| 2FH21F_14_026 | — | — | — | — |
| 2FH21F_14_027 | Yes | — | — | — |
| 2FH21F_14_028 | Yes | — | — | — |
| 2FH21F_14_033 | — | — | — | — |
| 2FH21F_14_035 | Yes | — | — | — |
| 2FH21F_14_037 | — | — | — | — |
| 2FH21F_14_039 | Yes | — | — | — |
| 2FH21F_14_040 | Yes | — | — | — |
| 2FH21F_15_002 | Yes | — | — | — |
| 2FH21F_15_004 | Yes | — | — | — |
| 2FH21F_15_005 | Yes | — | — | — |
| 2FH21F_15_009 | Yes | — | — | — |
| 2FH21F_15_010 | Yes | — | — | — |
| 2FH21F_15_011 | Yes | — | — | — |
| 2FH21F_15_015 | — | — | — | — |
| 2FH21F_15_016 | Yes | — | — | — |
| 2FH21F_15_017 | — | — | — | — |
| 2FH21F_15_018 | Yes | — | — | — |
| 2FH21F_15_019 | Yes | — | — | — |
| 2FH21F_15_021 | Yes | — | — | — |
| 2FH21F_15_024 | Yes | — | — | — |
| 2FH21F_15_025 | Yes | — | — | — |
| 2FH21F_15_026 | Yes | — | — | — |
| 2FH21F_15_027 | Yes | — | — | — |
| 2FH21F_15_030 | Yes | — | — | — |
| 2FH21F_15_031 | Yes | — | — | — |
| 2FH21F_15_032 | Yes | — | — | — |
| 2FH21F_15_033 | Yes | — | — | — |
| 2FH21F_15_034 | Yes | — | — | — |
| 2FH21F_15_038 | Yes | — | — | — |
| 2FH21F_15_040 | Yes | — | — | — |
| 2FH21F_15_041 | Yes | — | — | — |
| 2FH21F_15_042 | Yes | — | — | — |
| 2FH21F_15_043 | Yes | — | — | — |
| 2FH21F_15_044 | Yes | Yes | Yes | Yes |

TABLE 13-continued

| | | | | |
|---|---|---|---|---|
| 2FH21F_15_045 | — | — | — | — |
| 2FH21F_15_046 | Yes | — | — | — |
| 2FH21F_15_047 | — | — | — | — |
| 2FH21F_15_048 | Yes | — | — | — |
| 2FH21F_15_050 | Yes | — | — | — |
| 2FH21F_15_054 | Yes | — | — | — |
| 2FH21F_15_057 | Yes | — | — | — |
| 2FH21F_15_061 | — | — | — | — |
| 2FH21F_15_068 | — | — | — | — |
| 2FH21F_15_069 | Yes | — | — | — |
| 2FH21F_15_070 | Yes | — | — | — |
| 2FH21F_15_074 | Yes | — | — | — |
| 2FH21F_15_075 | Yes | — | — | — |
| 2FH21F_15_076 | Yes | — | — | — |
| 2FH21F_15_077 | Yes | — | — | — |
| 2FH21F_15_079 | — | — | — | — |
| 2FH21F_15_082 | Yes | — | — | — |
| 2FH21F_15_083 | — | — | — | — |
| 2FH21F_15_084 | Yes | Yes | — | — |
| 2FH21F_15_085 | Yes | — | — | — |
| 2FH21F_15_086 | Yes | — | — | — |
| 2FH21F_15_091 | Yes | — | — | — |
| 2FH21F_15_092 | Yes | — | — | — |
| 2FH21F_15_093 | Yes | — | — | — |
| 2FH21F_15_097 | — | — | — | — |
| 2FH21F_15_101 | Yes | — | — | — |
| 2FH21F_15_103 | — | — | — | — |
| 2FH21F_15_106 | Yes | — | — | — |
| 2FH21F_15_107 | Yes | — | — | — |
| 2FH21F_15_119 | Yes | — | — | — |
| 2FH21F_15_126 | Yes | — | — | — |
| 2FH21F_15_128 | Yes | — | — | — |
| 2FH21F_15_130 | Yes | — | — | — |
| 2FH21F_15_134 | Yes | — | — | — |
| 2FH21F_15_135 | Yes | — | — | — |
| 2FH21F_15_137 | Yes | — | — | — |
| 2FH21F_15_139 | Yes | — | — | — |
| 2FH21F_15_142 | Yes | — | — | — |
| 2FH21F_15_144 | Yes | — | — | — |
| 2FH21F_15_146 | Yes | Yes | Yes | — |
| 2FH21F_15_147 | — | — | — | — |
| 2FH21F_15_148 | Yes | — | — | — |
| 2FH21F_15_149 | Yes | Yes | — | — |
| 2FH21F_15_150 | Yes | — | — | — |
| 2FH21F_15_151 | Yes | — | — | — |
| 2FH21F_15_152 | Yes | — | — | — |
| 2FH21F_15_153 | Yes | — | — | — |
| 2FH21F_15_156 | Yes | — | — | — |
| 2FH21F_15_157 | Yes | — | — | — |
| 2FH21F_15_160 | Yes | — | — | — |
| 2FH21F_15_165 | — | — | — | — |
| 2FH21F_15_170 | — | Yes | — | — |
| 2FH21F_15_175 | Yes | — | — | — |
| 2FH21F_15_178 | Yes | — | — | — |
| 2FH21F_15_180 | Yes | — | — | — |
| 2FH21F_15_182 | Yes | — | — | — |
| 2FH21F_15_191 | Yes | — | — | — |
| 2FH21F_15_193 | Yes | — | — | — |
| 2FH21F_15_195 | Yes | — | — | — |
| 2FH21F_15_196 | Yes | — | — | — |
| 2FH21F_15_198 | Yes | — | — | — |
| 2FH21F_15_200 | Yes | — | — | — |
| 2FH21F_15_209 | Yes | — | — | — |
| 2FH21F_15_210 | Yes | Yes | — | — |
| 2FH21F_15_211 | Yes | Yes | — | — |
| 2FH21F_15_212 | — | — | — | — |
| 2FH21F_15_214 | Yes | — | — | — |
| 2FH21F_15_217 | Yes | — | — | — |
| 2FH21F_15_218 | Yes | Yes | — | — |
| 2FH21F_15_219 | — | — | — | — |
| 2FH21F_15_220 | Yes | Yes | Yes | — |
| 2FH21F_15_221 | Yes | Yes | — | — |
| 2FH21F_15_222 | Yes | — | — | — |
| 2FH21F_15_223 | Yes | Yes | — | — |
| 2FH21F_15_228 | Yes | — | — | — |
| 2FH21F_15_231 | Yes | — | — | — |
| 2FH21F_15_234 | — | Yes | — | — |
| 2FH21F_15_236 | Yes | — | — | — |
| 2FH21F_15_237 | Yes | — | — | — |
| 2FH21F_15_238 | Yes | — | — | — |

TABLE 13-continued

| | | | | |
|---|---|---|---|---|
| 2FH21F_15_239 | Yes | — | — | — |
| 2FH21F_15_241 | — | — | — | — |
| 2FH21F_15_242 | Yes | — | — | — |
| 2FH21F_15_243 | — | — | — | — |
| 2FH21F_15_244 | Yes | — | — | — |
| 2FH21F_15_247 | Yes | Yes | — | — |
| 2FH21F_15_248 | Yes | — | — | — |
| 2FH21F_16_004 | Yes | — | — | — |
| 2FH21F_16_005 | — | — | — | — |
| 2FH21F_16_006 | Yes | — | — | — |
| 2FH21F_16_010 | Yes | — | — | — |
| 2FH21F_16_011 | Yes | Yes | — | — |
| 2FH21F_16_012 | Yes | Yes | — | — |
| 2FH21F_16_014 | Yes | Yes | — | — |
| 2FH21F_16_015 | — | — | — | — |
| 2FH21F_16_016 | Yes | Yes | — | — |
| 2FH21F_16_018 | — | — | — | — |
| 2FH21F_16_019 | Yes | — | — | — |
| 2FH21F_16_021 | Yes | — | — | — |
| 2FH21F_16_022 | Yes | — | — | — |
| 2FH21F_16_023 | — | Yes | — | — |
| 2FH21F_16_024 | — | — | — | — |
| 2FH21F_16_025 | Yes | — | — | — |
| 2FH21F_17_004 | Yes | — | — | — |
| 2FH21F_17_006 | Yes | — | — | — |
| 2FH21F_17_008 | — | — | — | — |
| 2FH21F_17_009 | Yes | — | — | — |
| 2FH21F_17_010 | — | — | — | — |
| 2FH21F_17_011 | Yes | — | — | — |
| 2FH21F_17_012 | — | — | — | — |
| 2FH21F_17_014 | Yes | — | — | — |
| 2FH21F_17_015 | Yes | — | — | — |
| 2FH21F_17_020 | Yes | — | — | — |
| 2FH21F_17_021 | Yes | — | — | — |
| 2FH21F_17_022 | — | — | — | — |
| 2FH21F_17_023 | — | — | — | — |
| 2FH21F_18_002 | — | — | — | — |
| 2FH21F_18_005 | Yes | Yes | — | — |
| 2FH21F_18_006 | Yes | — | — | — |
| 2FH21F_18_007 | Yes | — | — | — |
| 2FH21F_18_019 | — | Yes | Yes | — |
| 2FH21F_18_020 | Yes | Yes | Yes | Yes |
| 2FH21F_18_021 | — | Yes | — | — |
| 2FH21F_18_023 | Yes | Yes | — | — |
| 2FH21F_18_031 | Yes | — | — | — |
| 2FH21F_18_035 | Yes | — | — | — |
| 2FH21F_18_042 | — | — | — | — |
| 2FH21F_18_044 | Yes | — | — | — |
| 2FH21F_18_045 | Yes | Yes | — | — |
| 2FH21F_18_046 | — | — | — | — |
| 2FH21F_18_047 | Yes | Yes | — | — |
| 2FH21F_18_048 | Yes | — | — | — |
| 2FH21F_18_050 | Yes | — | — | — |
| 2FH21F_18_051 | Yes | Yes | — | — |
| 2FH21F_18_054 | — | — | — | — |
| 2FH21F_18_055 | Yes | — | — | — |
| 2FH21F_18_059 | Yes | Yes | Yes | Yes |
| 2FH21F_18_060 | Yes | Yes | Yes | — |
| 2FH21F_18_061 | Yes | Yes | Yes | — |
| 2FH21F_18_063 | Yes | — | — | — |
| 2FH21F_18_065 | Yes | — | — | — |
| 2FH21F_18_066 | Yes | Yes | — | — |
| 2FH21F_18_067 | Yes | — | — | — |
| 2FH21F_18_068 | Yes | — | — | — |
| 2FH21F_18_070 | Yes | — | — | — |
| 2FH21F_18_071 | Yes | — | — | — |
| 2FH21F_18_072 | Yes | Yes | — | — |
| 2FH21F_18_074 | Yes | Yes | — | — |
| 2FH21F_18_076 | Yes | Yes | Yes | Yes |
| 2FH21F_18_078 | Yes | — | — | — |
| 2FH21F_18_083 | Yes | Yes | Yes | — |
| 2FH21F_18_086 | Yes | — | — | — |
| 2FH21F_18_090 | Yes | — | — | — |
| 2FH21F_18_094 | Yes | Yes | Yes | Yes |
| 2FH21F_18_101 | Yes | Yes | — | — |
| 2FH21F_18_103 | Yes | Yes | — | — |
| 2FH21F_18_117 | Yes | — | — | — |
| 2FH21F_18_120 | — | — | — | — |
| 2FH21F_18_122 | Yes | — | — | — |
| 2FH21F_18_123 | Yes | — | — | — |

TABLE 13-continued

| | | | | |
|---|---|---|---|---|
| 2FH21F_18_126 | Yes | — | — | — |
| 2FH21F_18_127 | Yes | Yes | — | — |
| 2FH21F_18_132 | Yes | — | — | — |
| 2FH21F_18_133 | Yes | — | — | — |
| 2FH21F_18_136 | — | — | — | — |
| 2FH21F_18_137 | Yes | — | — | — |
| 2FH21F_18_138 | Yes | — | — | — |
| 2FH21F_18_139 | — | — | — | — |
| 2FH21F_18_141 | — | — | — | — |
| 2FH21F_18_142 | Yes | — | — | — |
| 2FH21F_18_143 | Yes | — | — | — |
| 2FH21F_18_144 | Yes | — | — | — |
| 2FH21F_18_145 | — | — | — | — |
| 2FH21F_18_149 | — | Yes | — | — |
| 2FH21F_18_151 | Yes | Yes | Yes | — |
| 2FH21F_18_153 | Yes | — | — | — |
| 2FH21F_18_154 | Yes | Yes | Yes | Yes |
| 2FH21F_18_156 | Yes | — | — | — |
| 2FH21F_18_158 | Yes | — | — | — |
| 2FH21F_18_159 | Yes | Yes | — | — |
| 2FH21F_18_160 | Yes | — | — | — |
| 2FH21F_18_161 | Yes | — | — | — |
| 2FH21F_18_162 | Yes | — | — | — |
| 2FH21F_18_171 | Yes | Yes | Yes | Yes |
| 2FH21F_18_172 | Yes | — | — | — |
| 2FH21F_18_173 | Yes | — | — | — |
| 2FH21F_18_174 | Yes | — | — | — |
| 2FH21F_18_175 | Yes | — | — | — |
| 2FH21F_18_176 | Yes | Yes | Yes | Yes |
| 2FH21F_18_178 | Yes | Yes | Yes | Yes |
| 2FH21F_18_186 | Yes | — | — | — |
| 2FH21F_18_188 | Yes | Yes | Yes | Yes |
| 2FH21F_18_190 | — | Yes | Yes | Yes |
| 2FH21F_18_191 | Yes | Yes | Yes | Yes |
| 2FH21F_18_194 | Yes | Yes | — | — |
| 2FH21F_18_195 | — | — | — | — |
| 2FH21F_18_197 | Yes | — | — | — |
| 2FH21F_18_198 | — | Yes | — | — |
| 2FH21F_18_199 | Yes | — | — | — |
| 2FH21F_18_200 | Yes | — | — | — |
| 2FH21F_18_201 | Yes | — | — | — |
| 2FH21F_18_202 | Yes | Yes | — | — |
| 2FH21F_18_203 | — | — | — | — |
| 2FH21F_18_204 | Yes | — | — | — |
| 2FH21F_18_212 | Yes | — | — | — |
| 2FH21F_18_213 | Yes | Yes | — | — |
| 2FH21F_18_216 | Yes | Yes | Yes | — |
| 2FH21F_18_217 | Yes | — | — | — |
| 2FH21F_18_219 | Yes | — | — | — |
| 2FH21F_18_223 | Yes | — | — | — |
| 2FH21F_18_224 | Yes | Yes | — | — |
| 2FH21F_18_226 | Yes | — | — | — |
| 2FH21F_18_233 | Yes | Yes | — | — |
| 2FH21F_18_234 | Yes | — | — | — |
| 2FH21F_18_241 | Yes | Yes | — | — |
| 2FH21F_18_243 | — | Yes | — | — |
| 2FH21F_18_244 | Yes | — | — | — |
| 2FH21F_18_245 | Yes | — | — | — |
| 2FH21F_18_252 | — | — | — | — |
| 2FH21F_18_254 | Yes | — | — | — |
| 2FH21F_18_255 | Yes | — | — | — |
| 2FH21F_18_260 | Yes | — | — | — |
| 2FH21F_18_261 | Yes | Yes | Yes | — |
| 2FH21F_18_262 | Yes | Yes | Yes | Yes |
| 2FH21F_18_268 | Yes | Yes | — | — |
| 2FH21F_18_269 | — | — | — | — |
| 2FH21F_18_270 | Yes | Yes | Yes | Yes |
| 2FH21F_18_271 | Yes | — | — | — |
| 2FH21F_18_272 | Yes | — | — | — |
| 2FH21F_18_273 | Yes | Yes | — | — |
| 2FH21F_18_274 | Yes | — | — | — |
| 2FH21F_18_275 | Yes | — | — | — |
| 2FH21F_18_276 | — | Yes | Yes | — |
| 2FH21F_18_277 | Yes | Yes | Yes | — |
| 2FH21F_18_284 | Yes | — | — | — |
| 2FH21F_18_292 | Yes | — | — | — |
| 2FH21F_18_293 | Yes | — | — | — |
| 2FH21F_18_296 | — | — | — | — |
| 2FH21F_18_300 | Yes | — | — | — |
| 2FH21F_18_301 | Yes | — | — | — |

TABLE 13-continued

| | | | | |
|---|---|---|---|---|
| 2FH21F_18_303 | — | — | — | — |
| 2FH21F_18_304 | Yes | — | — | — |
| 2FH21F_18_305 | Yes | — | — | — |
| 2FH21F_18_307 | — | — | — | — |
| 2FH21F_18_314 | — | — | — | — |
| 2FH21F_18_319 | Yes | Yes | — | — |
| 2FH21F_18_326 | Yes | Yes | — | — |
| 2FH21F_18_327 | Yes | — | — | — |
| 2FH21F_18_328 | Yes | — | — | — |
| 2FH21F_18_329 | Yes | — | — | — |
| 2FH21F_18_330 | Yes | — | — | — |
| 2FH21F_18_332 | — | Yes | Yes | Yes |
| 2FH21F_18_333 | Yes | — | — | — |
| 2FH21F_18_340 | Yes | — | — | — |
| 2FH21F_18_344 | Yes | Yes | — | — |
| 2FH21F_18_346 | Yes | Yes | Yes | Yes |
| 2FH21F_18_349 | Yes | — | — | — |
| 2FH21F_18_350 | Yes | — | — | — |
| 2FH21F_18_351 | — | — | — | — |
| 2FH21F_18_352 | Yes | — | — | — |
| 2FH21F_18_354 | Yes | — | — | — |
| 2FH21F_18_355 | Yes | — | — | — |
| 2FH21F_18_357 | Yes | — | — | — |
| 2FH21F_18_364 | Yes | Yes | — | — |
| 2FH21F_18_365 | Yes | — | — | — |
| 2FH21F_18_369 | — | — | — | — |
| 2FH21F_18_370 | Yes | — | — | — |
| 2FH21F_18_375 | Yes | — | — | — |
| 2FH21F_18_380 | — | — | — | — |
| 2FH21F_18_386 | Yes | — | — | — |
| 2FH21F_18_388 | Yes | Yes | — | — |
| 2FH21F_18_398 | Yes | — | — | — |
| 2FH21F_18_399 | Yes | — | — | — |
| 2FH21F_18_402 | Yes | — | — | — |
| 2FH21F_18_403 | Yes | — | — | — |
| 2FH21F_18_405 | Yes | — | — | — |
| 2FH21F_18_408 | Yes | — | — | — |
| 2FH21F_18_409 | Yes | — | — | — |
| 2FH21F_18_412 | Yes | — | — | — |
| 2FH21F_18_414 | Yes | — | — | — |
| 2FH21F_18_415 | Yes | — | — | — |
| 2FH21F_18_417 | — | — | — | — |
| 2FH21F_18_419 | Yes | — | — | — |
| 2FH21F_18_427 | Yes | — | — | — |
| 2FH21F_18_428 | Yes | — | — | — |
| 2FH21F_18_429 | Yes | — | — | — |
| 2FH21F_18_430 | Yes | — | — | — |
| 2FH21F_18_432 | Yes | — | — | — |
| 2FH21F_18_434 | Yes | — | — | — |
| 2FH21F_18_435 | Yes | — | — | — |
| 2FH21F_18_441 | Yes | — | — | — |
| 2FH21F_18_446 | Yes | — | — | — |
| 2FH21F_18_457 | Yes | — | — | — |
| 2FH21F_18_459 | Yes | — | — | — |
| 2FH21F_18_460 | Yes | Yes | — | — |
| 2FH21F_18_461 | Yes | — | — | — |
| 2FH21F_18_462 | — | — | — | — |
| 2FH21F_18_463 | — | — | — | — |
| 2FH21F_18_466 | Yes | — | — | — |
| 2FH21F_18_467 | Yes | Yes | — | — |
| 2FH21F_18_468 | Yes | Yes | — | — |
| 2FH21F_18_469 | Yes | — | — | — |
| 2FH21F_18_470 | Yes | — | — | — |
| 2FH21F_18_472 | — | — | — | — |
| 2FH21F_18_474 | Yes | — | — | — |
| 2FH21F_18_475 | — | — | — | — |
| 2FH21F_18_476 | Yes | — | — | — |
| 2FH21F_18_480 | — | — | — | — |
| 2FH21F_18_481 | Yes | — | — | — |
| 2FH21F_18_482 | — | Yes | — | — |
| 2FH21F_18_483 | Yes | — | — | — |
| 2FH21F_18_485 | Yes | — | — | — |
| 2FH21F_18_490 | Yes | — | — | — |
| 2FH21F_18_491 | — | — | — | — |
| 2FH21F_18_494 | Yes | — | — | — |
| 2FH21F_18_497 | Yes | — | — | — |
| 2FH21F_18_501 | Yes | — | — | — |
| 2FH21F_18_502 | Yes | — | — | — |
| 2FH21F_18_503 | Yes | — | — | — |
| 2FH21F_18_504 | Yes | Yes | — | — |

TABLE 13-continued

| | | | | |
|---|---|---|---|---|
| 2FH21F_18_505 | Yes | — | — | — |
| 2FH21F_18_506 | Yes | — | — | — |
| 2FH21F_18_508 | Yes | — | — | — |
| 2FH21F_18_509 | Yes | Yes | — | — |
| 2FH21F_18_510 | Yes | Yes | — | — |
| 2FH21F_18_511 | — | Yes | — | — |
| 2FH21F_18_512 | Yes | — | — | — |
| 2FH21F_18_513 | Yes | — | — | — |
| 2FH21F_18_515 | Yes | — | — | — |
| 2FH21F_18_516 | Yes | — | — | — |
| 2FH21F_18_517 | Yes | — | — | — |
| 2FH21F_18_518 | Yes | — | — | — |
| 2FH21F_18_519 | Yes | — | — | — |
| 2FH21F_18_520 | Yes | — | — | — |
| 2FH21F_18_521 | Yes | Yes | — | — |
| 2FH21F_18_522 | — | Yes | — | — |
| 2FH21F_18_523 | — | Yes | — | — |
| 2FH21F_18_524 | Yes | — | — | — |
| 2FH21F_18_525 | Yes | — | — | — |
| 2FH21F_18_526 | Yes | — | — | — |
| 2FH21F_18_527 | Yes | — | — | — |
| 2FH21F_18_529 | — | Yes | — | — |
| 2FH21F_18_530 | Yes | Yes | — | — |
| 2FH21F_18_534 | Yes | — | — | — |
| 2FH21F_18_535 | Yes | — | — | — |
| 2FH21F_18_536 | Yes | — | Yes | — |
| 2FH21F_18_537 | — | — | — | — |
| 2FH21F_18_538 | — | Yes | — | — |
| 2FH21F_18_539 | Yes | — | — | — |
| 2FH21F_18_543 | — | — | — | — |
| 2FH21F_18_545 | Yes | — | — | — |
| 2FH21F_18_548 | Yes | Yes | Yes | — |
| 2FH21F_18_549 | Yes | Yes | — | — |
| 2FH21F_18_555 | Yes | — | — | — |
| 2FH21F_18_565 | Yes | Yes | — | — |
| 2FH21F_18_566 | Yes | Yes | Yes | — |
| 2FH21F_18_567 | Yes | Yes | — | — |
| 2FH21F_18_570 | Yes | — | — | — |
| 2FH21F_18_571 | Yes | — | — | — |
| 2FH21F_18_574 | Yes | — | — | — |
| 2FH21F_18_576 | Yes | — | — | — |
| 2FH21F_18_577 | Yes | Yes | Yes | — |
| 2FH21F_18_579 | Yes | — | — | — |
| 2FH21F_18_583 | Yes | — | — | — |
| 2FH21F_18_585 | Yes | — | — | — |
| 2FH21F_18_590 | Yes | — | — | — |
| 2FH21F_18_594 | Yes | Yes | Yes | — |
| 2FH21F_19_004 | Yes | — | — | — |
| 2FH21F_19_005 | — | — | — | — |
| 2FH21F_19_006 | Yes | — | — | — |
| 2FH21F_19_007 | — | — | — | — |
| 2FH21F_19_010 | — | — | — | — |
| 2FH21F_19_012 | — | — | — | — |
| 2FH21F_19_014 | — | — | — | — |
| 2FH21F_19_015 | Yes | — | — | — |
| 2FH21F_19_016 | Yes | Yes | — | — |
| 2FH21F_19_018 | Yes | Yes | — | — |
| 2FH21F_19_022 | Yes | Yes | — | — |
| 2FH21F_19_026 | Yes | — | — | — |
| 2FH21F_19_027 | Yes | Yes | Yes | — |
| 2FH21F_19_028 | Yes | Yes | — | — |
| 2FH21F_19_030 | Yes | — | — | — |
| 2FH21F_19_031 | Yes | Yes | — | — |
| 2FH21F_20_003 | Yes | — | — | — |
| 2FH21F_20_004 | — | — | — | — |
| 2FH21F_20_006 | Yes | — | — | — |
| 2FH21F_20_007 | Yes | — | — | — |
| 2FH21F_20_008 | Yes | — | — | — |
| 2FH21F_20_009 | — | — | — | — |
| 2FH21F_20_010 | — | — | — | — |
| 2FH21F_20_011 | Yes | — | — | — |
| 2FH21F_20_012 | — | — | — | — |
| 2FH21F_20_013 | — | — | — | — |
| 2FH21F_20_014 | Yes | — | — | — |
| 2FH21F_20_015 | Yes | — | — | — |
| 2FH21F_20_016 | Yes | — | — | — |
| 2FH21F_20_017 | — | — | — | — |
| 2FH21F_20_018 | Yes | — | — | — |
| 2FH21F_20_020 | Yes | — | — | — |
| 2FH21F_22_012 | Yes | — | — | — |

TABLE 13-continued

| | | | | |
|---|---|---|---|---|
| 2FH21F__22__016 | Yes | — | — | — |
| 2FH21F__22__017 | Yes | — | — | — |
| 2FH21F__22__018 | Yes | — | — | — |
| 2FH21F__22__019 | Yes | — | — | — |
| 2FH21F__22__021 | Yes | — | — | — |
| 2FH21F__22__025 | Yes | — | — | — |
| 2FH21F__22__026 | Yes | — | — | — |
| 2FH21F__22__028 | Yes | — | — | — |
| 2FH21F__22__029 | Yes | — | — | — |
| 2FH21F__22__030 | Yes | — | — | — |
| 2FH21F__22__035 | Yes | — | — | — |
| 2FH21F__22__036 | — | — | — | — |
| 2FH21F__22__037 | — | — | — | — |
| 2FH21F__22__040 | Yes | — | — | — |
| 2FH21F__22__042 | Yes | — | — | — |
| 2FH21F__22__043 | Yes | — | — | — |
| 2FH21F__22__044 | Yes | — | — | — |
| 2FH21F__22__047 | Yes | — | — | — |
| 2FH21F__22__048 | Yes | — | — | — |
| 2FH21F__22__051 | Yes | — | — | — |
| 2FH21F__22__055 | Yes | — | — | — |
| 2FH21F__22__056 | Yes | — | — | — |
| 2FH21F__22__057 | — | — | — | — |
| 2FH21F__22__059 | Yes | — | — | — |
| 2FH21F__22__061 | Yes | — | — | — |
| 2FH21F__22__062 | Yes | — | — | — |
| 2FH21F__22__067 | Yes | Yes | — | — |
| 2FH21F__22__068 | — | — | — | — |
| 2FH21F__22__073 | Yes | — | — | — |
| 2FH21F__22__074 | — | Yes | — | — |
| 2FH21F__22__075 | Yes | — | — | — |
| 2FH21F__22__076 | Yes | — | — | — |
| 2FH21F__22__077 | Yes | — | — | — |
| 2FH21F__22__078 | Yes | — | — | — |
| 2FH21F__22__079 | — | — | — | — |
| 2FH21F__22__080 | — | — | — | — |
| 2FH21F__22__081 | — | — | — | — |
| 2FH21F__22__082 | Yes | — | — | — |
| 2FH21F__22__085 | — | — | — | — |

*Experiment 3, Tier IV sequence sets have not been tested on plasma samples.

Multiplex Scheme

Provided in Table 14 below is a multiplex scheme with a subset of nucleotide sequence sets that perform well. The multiplex scheme was designed by first including top-performing sequence sets from DNA Sets 1 and 3 from Experiment 3 and replexing these sets. This approach ensures that these top-performing sets are included in a design and are more highly represented in a single multiplex scheme. Next, a "superplex" was performed. Superplexing takes an existing assay (in this case, the top-performing replex from DNA Sets 1 and 3) and adds additional top-performing sequence sets to fill in to a desired plex level (in this case 56 sequence sets). This approach optimizes markers in a consolidated mulitplex scheme. When designing the multiplex schemes, those markers that are in close proximity (<1000 bases) and may co-amplify are not included in the same, single multiplex reaction. In Table 14, the WELL corresponds to those sequence sets included in the same single reaction, i.e., all of the sequence sets from well W1 are assayed in the same single reaction.

TABLE 14

Multiplex Scheme

| WELL | MARKER_ID | PCR Primer 1 | SEQ ID NO: | PCR Primer 2 | SEQ ID NO: | Extension Primer | SEQ ID NO: |
|---|---|---|---|---|---|---|---|
| W1 | 2FH21F_01_030 | GTACTCAAATCAAATTGGC | 5010 | GAGGCAACTAGGACTTAAGG | 5066 | TCAAATTGGCTTACTTGC | 5122 |
| W1 | 2FH21F_02_075 | GAAAAAAGTGCATGTCTTTG | 5011 | AGATTATGATGCACTGGCCT | 5067 | TGATGAATGCAGTGAAGTC | 5123 |
| W1 | 2FH21F_02_107 | CCCAGATGAAGGGGTTTTAG | 5012 | GGAAAGTTAGAAGGCCACAC | 5068 | GTTTTAGTATTGAATTTAGTGCTTAG | 5124 |
| W1 | 2FH21F_02_148 | AAGACCAAGATTCAGAAGC | 5013 | TTGTTGCTCCAAGTTTAAG | 5069 | GCAGGGCTATGCGGGAG | 5125 |
| W1 | 2FH21F_05_006 | GTGAATTCTTCCCACTTCTC | 5014 | GTTTTCCCATATCTAGATGTC | 5070 | CACTTCTCACTTATCATCTG | 5126 |
| W1 | 2FH21F_06_114 | GAGAATTAAAATGAACTGAG | 5015 | TACTTAATCCTTTTGCCTC | 5071 | GAATTAAAATGAACTGAGGATTTC | 5127 |
| W1 | 2FH21F_06_165 | GGTACCACTCATCCATAAAC | 5016 | GGGCTGTTTCAATGAGGGAC | 5072 | TCCATAAACACCAACACT | 5128 |

TABLE 14-continued

Multiplex Scheme

| WELL | MARKER_ID | PCR Primer 1 | SEQ ID NO: | PCR Primer 2 | SEQ ID NO: | Extension Primer | SEQ ID NO: |
|---|---|---|---|---|---|---|---|
| W1 | 2FH21F_06_219 | ACCCTCAGTACCACTATCTC | 5017 | CTTGTATTAAAAGAAGTGG | 5073 | CCTCAGTACCACTATCTCAATCTT | 5129 |
| W1 | 2FH21F_06_224 | CAAGGATTCCAGTACTGGAG | 5018 | GGAGTCAAGGGAGCATTTTA | 5074 | CCAGTACTGGAGAATGTCT | 5130 |
| W1 | 2FH21F_09_007 | CATATTTGTCTGTGTACTTG | 5019 | GAGGCAAACATTATACACAC | 5075 | TTGTCTGTGTACTTGTGCTCT | 5131 |
| W1 | 2FH21F_11_022 | GGAATGTTCCACCTTTCTAC | 5020 | ACTGAAGTCATTCATTAGG | 5076 | AATGTTCCACCTTTCTACCTTTTTT | 5132 |
| W1 | 2FH21F_12_052 | CTTCAAGGCAATCTTTCTCC | 5021 | GCAGGTTCACAGGAAGTTTC | 5077 | GCAATCTTTCTCCATAAACATA | 5133 |
| W1 | 2FH21F_12_074 | ACCAGCTACATCTAGATTAC | 5022 | CTGTGAGGCCAATGCAAATG | 5078 | GCTACATCTAGATTACAAGCCTTAT | 5134 |
| W1 | 2FH21F_18_094 | AGCTCCGCTTTGATTTCAGG | 5023 | GTGGCTATGAAAGACAGCCT | 5079 | TTGATTTCAGGCTTCATAGTTTG | 5135 |
| W1 | 2FH21F_18_171 | TTCCTGATGATAATCTTCCC | 5024 | GGGAAGATCTTAAAGGGAGC | 5080 | TATAGCCAATAAATTACTCTTATTTTA | 5136 |
| W1 | 2FH21F_18_176 | AACGGCCAGGGTGGACACT | 5025 | ACACCACATTTCTACCACTG | 5081 | GCCAGGGTGGACACTGTTACT | 5137 |
| W1 | 2FH21F_18_191 | GATGCTTCTAAGGACCATGT | 5026 | TGATACAGAAATGTCAACCC | 5082 | GGACCATGTAATTTCTTTAATTC | 5138 |
| W1 | 2FH21F_18_262 | CCATAGCAAGATGAATTCAC | 5027 | CTCCCCAAAGTCTCAGATAG | 5083 | CAAGATGAATTCACTTAACGAAGTT | 5139 |
| W2 | 2FH21F_01_041 | CACCAGTATCAGCAATAGCTT | 5028 | GGAACAGTGTTGATAAAGACT | 5084 | TCAGCAATAGCTTTGACTT | 5140 |
| W2 | 2FH21F_02_091 | GTGCCTAAGGACAACTTTTTC | 5029 | CCAAATTTTCAAGCAAAGC | 5085 | GGACAACTTTTTCTTTTTCTTCT | 5141 |
| W2 | 2FH21F_05_003 | GAACCATGGTTTGGGTTTAC | 5030 | GAAGTGGCCTATCAGGTCT | 5086 | CTGTTCTATTACAGTGTTCTTC | 5142 |
| W2 | 2FH21F_05_033 | AATAAAGTCCAGAGTATGGC | 5031 | GGACTTTGGCACCCAAGGA | 5087 | AGAGTATGGCTGGGAATT | 5143 |
| W2 | 2FH21F_07_166 | ATTCCAAGGGCTATCTCCAC | 5032 | TTCCTACCTCACTTGGCTTC | 5088 | CCGGCTCTGAACGCCTC | 5144 |
| W2 | 2FH21F_07_202 | GCTGGATACCTAATTAATGC | 5033 | GTTACACTGCAAAGCATTTC | 5089 | GAACCAAACAAGGAAAATAC | 5145 |
| W2 | 2FH21F_07_464 | AGGTAGTTCTCTAAGTTAC | 5034 | GGCAAACATAATTTGGATGGG | 5090 | AGGTAGTTCTCTAAGTTACCAAAATC | 5146 |
| W2 | 2FH21F_09_010 | ACAAATATTGACAGGCAGCA | 5035 | CTGTGTCAAATATGTGACTG | 5091 | GACAGGCAGCAGATTAT | 5147 |
| W2 | 2FH21F_10_005 | GAACAGCTATATTTCAAACCC | 5036 | TTTCAGACCATTTTTGAAC | 5092 | AACAGCTATATTTCAAACCCTTTTTA | 5148 |
| W2 | 2FH21F_12_049 | CTTCCTGTGAACCTGCTTTC | 5037 | AAGAGGGAAGATGACTTTTC | 5093 | GCTATCTTACTTTTCTTTATTCCAC | 5149 |
| W2 | 2FH21F_12_075 | GAGGCCAATGCAAATGTAGG | 5038 | CAGAGGGTAGAAGGGAGGC | 5094 | GTAATCTAGATGTAGCTGGTATCA | 5150 |
| W2 | 2FH21F_13_036 | CTTATCCTTTGGGTCTTCTC | 5039 | GAGTTCTAGTTTGGCAAACTT | 5095 | TTAACCTCTGTTTCAAAATACTGG | 5151 |
| W2 | 2FH21F_13_041 | TTGTGTGTAGGATTATGAGC | 5040 | ATGCTGATGAACCGCACTTC | 5096 | TGTGTGTAGGATTATGAGCATCCATT | 5152 |
| W2 | 2FH21F_15_044 | GAATGTAGCTGTTGTTAGGG | 5041 | CTGGGCAACTGTGAAAAGAC | 5097 | TGTAGCTGTTGTTAGGGATAGGAGA | 5153 |
| W2 | 2FH21F_18_020 | TCCCTCTCTCCCTGAAAAAG | 5042 | GACCAAAGTGTATACATAG | 5098 | AAAAGAGACACATTTGCCTTTG | 5154 |
| W2 | 2FH21F_18_076 | GACTAGGTTACTGAGCAAGG | 5043 | CCTTTTAAAATATGCACGAG | 5099 | GTTACTGAGCAAGGAAAATAA | 5155 |
| W2 | 2FH21F_18_154 | TTAGATTGTTATCCCCACT | 5044 | TAAATGAGCAGAGACTCAAG | 5100 | TGTTATCCCACTTCTTTAA | 5156 |
| W2 | 2FH21F_18_190 | AAGAACTCCAGGGCTACTTG | 5045 | AAAGCTTAACAAGTTGGCG | 5101 | AGGGCTACTTGAACAATT | 5157 |
| W2 | 2FH21F_18_270 | TGGTTCTCAACACTGACCAC | 5046 | GTTGTGACTATTGTTATAG | 5102 | CCACTAGTATTAACATACAGTTTA | 5158 |
| W2 | 2FH21F_18_332 | ATGTAGGCATTGTAATGAGG | 5047 | GACTTGAATTTAACTGCTCC | 5103 | AATGAGGTTTTTGGTCTTTG | 5159 |
| W2 | 2FH21F_18_346 | GATAACATAAGATTAGGAAC | 5048 | AACTTGCCTTCAAGATCTG | 5104 | ACATAAGATTAGGAACAAGAATA | 5160 |
| W3 | 2FH21F_02_076 | GATTATGATGCACTGGCCTG | 5049 | GAAAAAGTGCATGTCTTTG | 5105 | GACTTCACTGCATTCATCAGC | 5161 |

TABLE 14-continued

Multiplex Scheme

| WELL | MARKER_ID | PCR Primer 1 | SEQ ID NO: | PCR Primer 2 | SEQ ID NO: | Extension Primer | SEQ ID NO: |
|---|---|---|---|---|---|---|---|
| W3 | 2FH21F_02_089 | CTGAAGAAGTGTAAAAATGGC | 5050 | GTCTACCAAACTACAATTAG | 5106 | GGCAACATGCATATAGAG | 5162 |
| W3 | 2FH21F_02_111 | CTGCTAACTCAGATACCTGC | 5051 | CTTTCCAAAAACCCACAATC | 5107 | CAGATACCTGCATGTCA | 5163 |
| W3 | 2FH21F_02_116 | GTCTCACATCCCATTTACAG | 5052 | AGGGCTGCAGGGACAGTAG | 5108 | CCCATTTACAGTTTATGTGTCAGCTAC | 5164 |
| W3 | 2FH21F_02_254 | TCAATTAGAAATCTAGTGC | 5053 | TATTTTTATTTCCAATGTAG | 5109 | CAATTAGAAATCTAGTGCAAAAGAAT | 5165 |
| W3 | 2FH21F_03_005 | TATATAATACTTAGTTTTGG | 5054 | TCATCCCCATTTCTCAACTC | 5110 | ATACTTAGTTTTGGTCATCAA | 5166 |
| W3 | 2FH21F_03_022 | TTCCTTTATGGGAGGAGGAG | 5055 | GCTGATCAAGGCAGTTTTTC | 5111 | TTTCTTTCTATGTCTTTGGTTAT | 5167 |
| W3 | 2FH21F_05_027 | ATTGGCCAACATCTCAACAG | 5056 | TTTAGCATTCCCAGACTCAG | 5112 | ACATCTCAACAGAGTTACA | 5168 |
| W3 | 2FH21F_05_061 | GTGTGCTTGCCTCCTAATTT | 5057 | ACTGTTATGTACATTATATC | 5113 | CCTCCTAATTTAAAATACTGTATTC | 5169 |
| W3 | 2FH21F_06_218 | GAAAGTTCTTGTATTAAAAG | 5058 | ACCCTCAGTACCACTATCTC | 5114 | AAGTTCTTGTATTAAAAGAAGTGG | 5170 |
| W3 | 2FH21F_06_238 | TGTTCTTGGTTGACTTTAC | 5059 | TGTGTGCAAGGCTCTAGAAG | 5115 | AACAGAGAAAATTAAAATCAAACA | 5171 |
| W3 | 2FH21F_07_071 | CTTTTACCAGTTATCTTCC | 5060 | CCAAGGTTGCTTATAAACAG | 5116 | CTTCATTGCTTTCACTTTTC | 5172 |
| W3 | 2FH21F_07_465 | CATGGGCAAACATAATTTGG | 5061 | GTTCTCTAAGTTACCAAAATC | 5117 | CAAACATAATTTGGATGGGTCT | 5173 |
| W3 | 2FH21F_11_028 | CTGTGTCAATGGCACATCTG | 5062 | GTATATATAACTCCTGATC | 5118 | TGTGTCAATGGCACATCTGAATTACT | 5174 |
| W3 | 2FH21F_18_059 | ATATTTCAAGTATCACTATG | 5063 | CAGCATAGCTTTAATGGTCC | 5119 | ATTTCAAGTATCACTATGTACAATC | 5175 |
| W3 | 2FH21F_18_178 | GCATCAGGACAAACTGATGG | 5064 | TCTGTGACACAGAGCATGAG | 5120 | CAGCCTAGGTTTTCCTC | 5176 |
| W3 | 2FH21F_18_188 | GTGCTATAAAGCTTTAACAAG | 5065 | AACTCCAGGGCTACTTGAAC | 5121 | ATAAAGCTTTAACAAGTTGGCGA | 5177 |

Example 4: Detecting Fetal Chromosomal Abnormalities in Maternal Plasma

Embodiments of a method for detecting the presence or absence of a fetal chromosomal abnormality in a maternal blood sample are described hereafter. The method comprises a) preparing a set of amplified nucleic acid species by amplifying nucleotide sequences from extracellular nucleic acid template of a subject, wherein: (i) the extracellular nucleic acid template is heterogenous, (ii) each nucleotide sequences in the set is present on different chromosomes, (iii) each nucleotide sequence in the set differs by one or more mismatch nucleotides; (iv) each nucleotide sequence in the set is amplified at a substantially reproducible level relative to each other nucleotide sequence in the set, (v) the primer hybridization sequences in the extracellular nucleic acid template are substantially identical; and (vi) each amplified nucleic acid species in the set comprises a nucleotide sequence having the one or more mismatch nucleotides; and b) determining the amount of each amplified nucleic acid species in the set; whereby the presence or absence of the chromosome abnormality is identified based on the amount of the amplified nucleic acid species. Step (a) of the method often involves (1) extraction of nucleic acid from maternal blood, preferably from blood plasma or serum; (2) application of a nucleic acid amplification process to the extracted nucleic acids, where the nucleotide sequences of a set are amplified by a single set of primers; and (3) quantification of the nucleotide sequence amplification products based on the ratio of the specific products. A single assay has duplicate confirmation that utilizes internal controls to identify the presence of trisomy. (See FIG. 1).

The amplification and detection steps (2) and (3) may be performed so as to allow quantitative detection of the fetal-derived DNA in a background of maternal nucleic acid. Assays described herein can be optimized for biological and experimental variability by performing the assays across a number of samples under identical conditions. Likewise, the ratio of nucleotide sequence species can be compared to a standard control representing a ratio of nucleotide sequences from comparable biological samples obtained from pregnant women each carrying a chromosomally normal (euploid) fetus. Also, the ratio of nucleotide sequence species can be determined without amplification, wherein the amount of each species is determined, for example, by a sequencing and/or hybridization reaction.

Example 5: Analytical Models

Given the very high cost and scarcity of plasma samples, not every set of markers can be tested on these samples. Therefore, one can either make the assumption that the assays which show best classification accuracy on the model systems will also work best on plasma, or attempt to infer a conditional distribution of probability of the classification accuracy on plasma based on the observed discriminating power on the model systems.

One of the variables affecting the performance of each paralog region is the actual assay design. Since all the markers are evaluated in the context of a multiplex environment, one needs to investigate the effect of various multiplexing scenarios on the performance of the assays undergoing screening. One way in which this analysis can be accomplished is to compare changes in the following (or combinations thereof):

1) reaction performance (as characterized, e.g., by average extension rate and call rate);
2) significance of differences between population of allele frequencies corresponding to Normal and T21 samples;
3) significance of differences between apparent ethnic bias for both Normal as well as T21 samples;
4) changes in the dependency of the average separation between Normal and T21 allele frequencies as a function of the fraction of T21 contribution; and
5) changes in the information content for each individual assay. This content can be represented by a plurality of metrics, such as Information Gain, Gain Ratio, Gini index, ReliefF index. Graphical methods such as heatmaps can be very useful in the process of comparing multiple metrics.

Finally, for the selection of groups of markers that will be evaluated on plasma samples, one can consider standard metrics from the theory of statistical inference—e.g., true positive rate, false positive rate, true negative rate, false negative rate, positive predictive value, negative predictive value. These metrics can be obtained by applying a plurality of classifiers—e.g., Linear/Quadratic/Mixture Discriminant analysis, NaiveBayes, Neural Networks, Support Vector Machines, Boosting with Decision Trees, which are further described below. The classification accuracy of individual multiplexes or groups of multiplexes can be calculated, in conjecture with various methods of preventing over-fitting—e.g., repeated 10-fold cross-validation or leave-one-out cross validation. For robust estimates of such accuracy, a paired t-test can be applied in order to validate the significance of any observed differences. Comparisons with random selection of multiple assays (as coming from different multiplexes) can also be performed, as well as with "all stars" groups of assays (assays which, though coming from different multiplexes, show highest information content).

Some of the different models and methods that can be employed to analyze the data resulting from the methods and compositions are provided herein. Exemplary models include, but are not limited to, Decision Tree, Support Vector Machine (SVM)—Linear Kernel, Logistic Regression, Adaptive Boosting (AdaBoost), Naïve Bayes, Multilayer Perceptron, and Hidden Markov Model (HMM).

Support Vector Machine (SVM)—Linear Kernel—SVM (linear kernel) analyzes data by mapping the data into a high dimensional feature space, where each coordinate corresponds to one feature of the data items, transforming the data into a set of points in a Euclidean space.

Logistic Regression is used for prediction of the probability of occurrence of an event by fitting data to a logistic curve. It is a generalized linear model used for binomial regression.

AdaBoost is a meta-algorithm, and can be used in conjunction with many other learning algorithms to improve their performance. AdaBoost is adaptive in the sense that subsequent classifiers built are tweaked in favor of those instances misclassified by previous classifiers.

Naïve Bayes is a simple probabilistic classifier based on applying Bayes' theorem (from Bayesian statistics) with strong (naive) independence assumptions. A more descriptive term for the underlying probability model would be "independent feature model".

Hidden Markov Model (HMM) is defined by a collection of states and transitions from each state to one or more other states, along with a probability for each transition. Specifically, HMM is a double stochastic process with one underlying process (i.e. the sequence of states) that is not observable but may be estimated through a set of data that produce a sequence of observations. HMMs are helpful in treating problems where information is uncertain and/or incomplete. HMMs generally are established in two stages: (1) a training stage, where the stochastic process is estimated through extensive observation, and (2) an application stage where the model may be used in real time to obtain classifications of maximum probability.

Example 6: Examples of Embodiments

Provided hereafter are certain non-limiting examples of some embodiments of the technology.

A1. A method for identifying the presence or absence of a chromosome abnormality in a subject, which comprises:
  a. preparing a plurality of sets of amplified nucleic acid species by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and
  b. determining the amount of each amplified nucleic acid species in each set;
  whereby the presence or absence of the chromosome abnormality is identified based on the amount of the amplified nucleic acid species from two or more sets.

A2. The method of embodiment A1, wherein the chromosome abnormality is aneuploidy of a target chromosome.
A3. The method of embodiment A2, wherein the target chromosome is chromosome 21.
A4. The method of embodiment A2, wherein the target chromosome is chromosome 18.
A4. The method of embodiment A2, wherein the target chromosome is chromosome 13.
A6. The method of embodiment A2, wherein the target chromosome is chromosome X.
A7. The method of embodiment A2, wherein the target chromosome is chromosome Y.
A8. The method of embodiment A2, wherein each nucleotide sequence in a set is not present in a chromosome other than each target chromosome.
A9. The method of any one of embodiments A1-A8, wherein the extracellular nucleic acid is from blood.
A10. The method of embodiment A9, wherein the extracellular nucleic acid is from blood plasma.
A11. The method of embodiment A9, wherein the extracellular nucleic acid is from blood serum.
A12. The method of any one of embodiments A9-A11, wherein the blood is from a pregnant female subject.

A13. The method of embodiment A12, wherein the extracellular nucleic acid template is from a female subject in the first trimester of pregnancy.
A14. The method of embodiment A12, wherein the extracellular nucleic acid template is from a female subject in the second trimester of pregnancy.
A15. The method of embodiment A12, wherein the extracellular nucleic acid template is from a female subject in the third trimester of pregnancy.
A16. The method of embodiment A12, wherein the extracellular nucleic acid template comprises a mixture of maternal nucleic acid and fetal nucleic acid.
A17(a). The method of embodiment A16, wherein the fetal nucleic acid is about 5% to about 40% of the extracellular nucleic acid; or the number of fetal nucleic acid copies is about 10 copies to about 2000 copies of the total extracellular nucleic acid.
A17(b). The method of embodiment A16, wherein the fetal nucleic acid is greater than about 15% of the extracellular nucleic acid.
A18. The method of embodiment A16 or A17, which comprises determining the fetal nucleic acid concentration in the extracellular nucleic acid.
A19. The method of any one of embodiments A16-A18, which comprises enriching the extracellular nucleic acid for fetal nucleic acid.
A20. The method of any one of embodiments A1-A11, wherein the extracellular nucleic acid comprises a mixture of nucleic acid from cancer cells and nucleic acid from non-cancer cells.
A21. The method of any one of embodiments A1-A20, wherein each nucleotide sequence in a set is substantially identical to each other nucleotide sequence in the set.
A22. The method of embodiment A21, wherein each nucleotide sequence in a set is a paralog sequence.
A22. The method of embodiment A20 or A21, wherein each nucleotide sequence in each set shares about 50%, 60%, 70%, 80% or 90% identity with another nucleotide sequence in the set.
A23. The method of any one of embodiments A1-A22, wherein one or more of the nucleotide sequences are non-exonic.
A24. The method of embodiment A23, wherein one or more of the nucleotide sequences are intronic.
A25. The method of any one of embodiments A1-24, wherein the one or more nucleotide sequence species are selected from the group of nucleotide species shown in Table 4B.
A26. The method of any one of embodiments A1-A25, wherein one or more of the sets comprises two nucleotide sequences.
A27. The method of any one of embodiments A1-A26, wherein one or more of the sets comprises three nucleotide sequences.
A28. The method of any one of embodiments A1-A27, wherein in a set, nucleotide sequence species are on chromosome 21 and chromosome 18.
A29. The method of any one of embodiments A1-A27, wherein in a set, nucleotide sequence species are on chromosome 21 and chromosome 13.
A30. The method of any one of embodiments A1-A27, wherein in a set, nucleotide sequence species are on chromosome 21, chromosome 18 and chromosome 13.
A31. The method of any one of embodiments A1-A27, wherein each nucleotide sequence in all sets is present on chromosome 21, chromosome 18 and chromosome 13.

A32. The method of any one of embodiments A1-A32, wherein the amplification species of the sets are generated in one reaction vessel.
A33. The method of any one of embodiments A1-A33, wherein the amplified nucleic acid species in a set are prepared by a process that comprises contacting the extracellular nucleic acid with one reverse primer and one forward primer.
A34. The method of any one of embodiments A1-A34, wherein the amounts of the amplified nucleic acid species in each set vary by about 50% or less.
A35. The method of any one of embodiments A1-A35, wherein the amounts of the amplified nucleic acid species in each set vary by up to a value that permits detection of the chromosome abnormality with a confidence level of about 95% or more.
A36. The method of any one of embodiments A1-A35, wherein the amounts of the amplified nucleic acid species in each set vary by up to a value that permits detection of the chromosome abnormality with a sensitivity of about 90% or more, and a specificity of about 95% or more.
A37. The method of any one of embodiments A1-A36, wherein the length of each of the amplified nucleic acid species independently is about 30 to about 500 base pairs.
A38. The method of any one of embodiments A1-A37, wherein the amount of each amplified nucleic acid species is determined by primer extension, sequencing, digital PCR, QPCR, mass spectrometry.
A39. The method of any one of embodiments A1-A38, wherein the amplified nucleic acid species are detected by:
  contacting the amplified nucleic acid species with extension primers,
  preparing extended extension primers, and
  determining the relative amount of the one or more mismatch nucleotides by analyzing the extended extension primers.
A40. The method of embodiment A39, wherein the one or more mismatch nucleotides are analyzed by mass spectrometry.
A41. The method of any one of embodiments A1-A40, wherein there are about 4 to about 100 sets.
A42. The method of any one of embodiments A1-A41, wherein the presence or absence of the chromosome abnormality is based on the amounts of the amplified nucleic acid species in 80% or more of the sets.
A43. The method of any one of embodiments A1-A42, wherein the amounts of one or more amplified nucleic acid species are weighted differently than other amplified nucleic acid species for identifying the presence or absence of the chromosome abnormality.
A44. The method of any one of embodiments A1-A43, wherein the number of sets provides a sensitivity of 85% or greater for determining the absence of the chromosome abnormality.
A45. The method of any one of embodiments A1-A43, wherein the number of sets provides a specificity of 85% or greater for determining the presence of the chromosome abnormality.
A46. The method of any one of embodiments A1-A43, wherein the number of sets is determined based on (i) a 85% or greater sensitivity for determining the absence of the chromosome abnormality, and (ii) a 85% or greater specificity for determining the presence of the chromosome abnormality.
A47. The method of any one of embodiments A1-A46, which further comprises determining a ratio between the relative amount of (i) an amplified nucleic acid species and (ii) another amplified nucleic acid species, in each set; and determining the presence or absence of the chromosome abnormality is identified by the ratio.

A48. The method of any one of embodiments A1-A47, wherein the presence or absence of the chromosome abnormality is based on nine or fewer replicates.

A49. The method of embodiment A48, wherein the presence or absence of the chromosome abnormality is based on four replicates.

A50. The method of any one of embodiments A1-A47, wherein the nucleotide sequence species in the sets are not found on chromosome 18 or chromosome 13.

A51. The method of any one of embodiments A1-A47, wherein the nucleotide sequence species in the sets are any described herein, with the proviso that they are not selected from any designated by an asterisk in Table 4A.

A52. The method of any one of embodiments A1-A47, wherein there are about 10 to about 70 sets, and about 10 or more of the sets are selected from Table 14.

A53. The method of embodiment A52, wherein there are about 56 sets, wherein the sets are set forth in Table 14.

B1. A multiplex method for identifying the presence or absence of an abnormality of a target chromosome in a subject, which comprises:
  a. preparing three or more sets of amplified nucleic acid species by amplifying three or more nucleotide sequence sets from extracellular nucleic acid template of a subject, wherein: (i) the extracellular nucleic acid template is heterogenous, (ii) a nucleotide sequence in a set is present on a target chromosome and at least one other nucleotide sequence in the set is present on one or more reference chromosomes, (iii) the target chromosome is common for all of the sets; (iv) each nucleotide sequence in a set differs by one or more mismatch nucleotides from each other nucleotide sequence in the set; (v) each nucleotide sequence in a set is amplified at a substantially reproducible level relative to each other nucleotide sequence in the set, (vi) the primer hybridization sequences in the extracellular nucleic acid template are substantially identical; and (vii) each amplified nucleic acid species in a set comprises a nucleotide sequence having the one or more mismatch nucleotides; and
  b. determining the amount of each amplified nucleic acid species in each set;
  c. detecting the presence or absence of a decrease or increase of the target chromosome from the amount of each amplified nucleic acid species in the sets;
  whereby the presence or absence of the chromosome abnormality is identified based on a decrease or increase of the target chromosome relative to the one or more reference chromosomes.

C1. A method for identifying the presence or absence of a chromosome abnormality in a subject, which comprises:
  a. preparing a set of amplified nucleic acid species by amplifying nucleotide sequences from extracellular nucleic acid template of a subject, wherein: (i) the extracellular nucleic acid template is heterogenous, (ii) each nucleotide sequence in the set is present on three or more different chromosomes, (iii) each nucleotide sequence in the set differs by one or more mismatch nucleotides from each other nucleotide sequence in the set; (iv) each nucleotide sequence in the set is amplified at a substantially reproducible level relative to each other nucleotide sequence in the set, (v) the primer hybridization sequences in the extracellular nucleic acid template are substantially identical; and (vi) each amplified nucleic acid species in the set comprises a nucleotide sequence having the one or more mismatch nucleotides; and
  b. determining the amount of each amplified nucleic acid species in the set;
  whereby the presence or absence of the chromosome abnormality is identified based on the amount of the amplified nucleic acid species.

D1. A method for identifying the presence or absence of a chromosome abnormality associated with cancer in a subject, which comprises:
  a. preparing a set of amplified nucleic acid species by amplifying nucleotide sequences from nucleic acid template, wherein: (i) the nucleic acid template is from a cell-free sample from a subject and is heterogenous, (ii) each nucleotide sequence in the set is present on chromosome 21, chromosome 18 and chromosome 13, (iii) each nucleotide sequence in the set differs by one or more mismatch nucleotides from each other nucleotide sequence in the set; (iv) each nucleotide sequence in the set is amplified at a substantially reproducible level relative to each other nucleotide sequence in the set, (v) the primer hybridization sequences in the extracellular nucleic acid template are substantially identical; and (vi) each amplified nucleic acid species in the set comprises a nucleotide sequence having the one or more mismatch nucleotides; and
  b. determining the amount of each amplified nucleic acid species in the set;
  whereby the presence or absence of the chromosome abnormality associated with cancer is identified based on the amount of the amplified nucleic acid species in the set.

E1. A computer program product, comprising a computer usable medium having a computer readable program code embodied therein, said computer readable program code adapted to be executed to implement a method for identifying the presence or absence of a chromosome abnormality in a subject, said method comprising:
  providing a system, wherein the system comprises distinct software modules, and wherein the distinct software modules comprise a signal detection module, a logic processing module, and a data display organization module;
  detecting signal information derived from determining the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;
  receiving, by the logic processing module, the signal information;
  calling the presence or absence of a chromosomal abnormality by the logic processing module;

organizing, by the data display organization model in response to being called by the logic processing module, a data display indicating the presence or absence of a chromosome abnormality in the subject.

E2. A computer program product, comprising a computer usable medium having a computer readable program code embodied therein, said computer readable program code adapted to be executed to implement a method for identifying the presence or absence of a chromosome abnormality in a subject, said method comprising:

providing a system, wherein the system comprises distinct software modules, and wherein the distinct software modules comprise a signal detection module, a logic processing module, and a data display organization module;

parsing a configuration file into definition data that specifies: the amount of each amplified nucleic acid species in each set of claim A1;

receiving, by the logic processing module, the definition data;

calling the presence or absence of a chromosomal abnormality by the logic processing module;

organizing, by the data display organization model in response to being called by the logic processing module, a data display indicating the presence or absence of a chromosome abnormality in the subject.

E3. A computer program product, comprising a computer usable medium having a computer readable program code embodied therein, said computer readable program code adapted to be executed to implement a method for identifying the presence or absence of a chromosome abnormality in a subject, said method comprising:

providing a system, wherein the system comprises distinct software modules, and wherein the distinct software modules comprise a signal detection module, a logic processing module, and a data display organization module;

receiving signal information indicating the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;

calling the presence or absence of a chromosomal abnormality by the logic processing module;

organizing, by the data display organization model in response to being called by the logic processing module, a data display indicating the presence or absence of a chromosome abnormality in the subject.

F1. A method for identifying the presence or absence of a chromosome abnormality in a subject, which comprises:

a. providing a system, wherein the system comprises distinct software modules, and wherein the distinct software modules comprise a signal detection module, a logic processing module, and a data display organization module;

b. detecting signal information derived from determining the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;

c. receiving, by the logic processing module, the signal information;

d. calling the presence or absence of a chromosomal abnormality by the logic processing module, whereby the presence or absence of the chromosome abnormality is identified based on the amount of the amplified nucleic acid species from two or more sets; and e. organizing, by the data display organization model in response to being called by the logic processing module, a data display indicating the presence or absence of a chromosome abnormality in the subject.

F2. A method for identifying the presence or absence of a chromosome abnormality in a subject, which comprises:

a. obtaining a plurality of sets of amplified nucleic acid species prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;

b. providing a system, wherein the system comprises distinct software modules, and wherein the distinct software modules comprise a signal detection module, a logic processing module, and a data display organization module;

c. parsing a configuration file into definition data that specifies: the amount of each amplified nucleic acid species;

d. receiving, by the logic processing module, the definition data;

e. calling the presence or absence of a chromosomal abnormality by the logic processing module, whereby the presence or absence of the chromosome abnormality is identified based on the amount of the amplified nucleic acid species from two or more sets; and f. organizing, by the data display organization model in response to being called by the logic processing module, a data display indicating the presence or absence of a chromosome abnormality in the subject.

F3. A method for identifying the presence or absence of a chromosome abnormality in a subject, which comprises:
  a. preparing a plurality of sets of amplified nucleic acid species by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;
  b. providing a system, wherein the system comprises distinct software modules, and wherein the distinct software modules comprise a signal detection module, a logic processing module, and a data display organization module; (please have someone review which modules are needed, or if we need more steps/description)
  c. parsing a configuration file into definition data that specifies: the amount of each amplified nucleic acid species;
  d. receiving, by the logic processing module, the definition data;
  e. calling the presence or absence of a chromosomal abnormality by the logic processing module, whereby the presence or absence of the chromosome abnormality is identified based on the amount of the amplified nucleic acid species from two or more sets; and
  f. organizing, by the data display organization model in response to being called by the logic processing module, a data display indicating the presence or absence of a chromosome abnormality in the subject.

F4. A method for identifying the presence or absence of a chromosome abnormality in a subject, which comprises:
  a. providing signal information indicating the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;
  b. providing a system, wherein the system comprises distinct software modules, and wherein the distinct software modules comprise a signal detection module, a logic processing module, and a data display organization module;
  c. receiving, by the logic processing module, the signal information;
  d. calling the presence or absence of a chromosomal abnormality by the logic processing module, whereby the presence or absence of the chromosome abnormality is identified based on the amount of the amplified nucleic acid species from two or more sets; and
  e. organizing, by the data display organization model in response to being called by the logic processing module, a data display indicating the presence or absence of a chromosome abnormality in the subject.

F5. A method for identifying the presence or absence of a chromosome abnormality in a subject, which comprises:
  a. providing a system, wherein the system comprises distinct software modules, and wherein the distinct software modules comprise a signal detection module, a logic processing module, and a data display organization module;
  b. receiving, by the logic processing module, signal information indicating the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;
  c. calling the presence or absence of a chromosomal abnormality by the logic processing module, whereby the presence or absence of the chromosome abnormality is identified based on the amount of the amplified nucleic acid species from two or more sets; and
  d. organizing, by the data display organization model in response to being called by the logic processing module, a data display indicating the presence or absence of a chromosome abnormality in the subject.

G1. A method for identifying the presence or absence of a chromosome abnormality in a subject, which comprises:
  a. detecting signal information, wherein the signal information represents the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v)

the primer hybridization sequences in the extracellular nucleic acid template are substantially identical; and (vi) each amplified nucleic acid species in a set comprises a nucleotide sequence having the one or more mismatch nucleotides;

b. transforming the signal information representing the amount of each amplified nucleic acid species in each set into identification data, wherein the identification data represents the presence or absence of the chromosome abnormality, whereby the presence or absence of the chromosome abnormality is identified based on the amount of the amplified nucleic acid species from two or more sets; and c. displaying the identification data.

G2. A method for identifying the presence or absence of a chromosome abnormality in a subject, which comprises:

a. preparing a plurality of sets of amplified nucleic acid species by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and b. obtaining a data set of values representing the amount of each amplified nucleic acid species in each set;

c. transforming the data set of values representing the amount of each amplified nucleic acid species in each set into identification data, wherein the identification data represents the presence or absence of the chromosome abnormality, whereby the presence or absence of the chromosome abnormality is identified based on the amount of the amplified nucleic acid species from two or more sets; and d. displaying the identified data.

G3. A method for identifying the presence or absence of a chromosome abnormality in a subject, which comprises:

a. providing signal information indicating the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;

b. transforming the signal information indicating the amount of each amplified nucleic acid species in each set into identification data, wherein the identification data represents the presence or absence of the chromosome abnormality, whereby the presence or absence of the chromosome abnormality is identified based on the amount of the amplified nucleic acid species from two or more sets; and c. displaying the identification data.

G4. A method for identifying the presence or absence of a chromosome abnormality in a subject, which comprises:

a. receiving signal information indicating the amount of each amplified nucleic acid species in each of a plurality of sets of amplified nucleic acid species, wherein the plurality of sets of amplified nucleic acid species are prepared by amplifying a plurality of nucleotide sequence sets from extracellular nucleic acid template of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides;

b. transforming the signal information indicating the amount of each amplified nucleic acid species in each set into identification data, wherein the identification data represents the presence or absence of the chromosome abnormality, whereby the presence or absence of the chromosome abnormality is identified based on the amount of the amplified nucleic acid species from two or more sets; and c. displaying the identification data.

H1. A method for transmitting prenatal genetic information to a human pregnant female subject, which comprises:

a. identifying the presence or absence of a chromosomal abnormality in the fetus of the pregnant female subject, wherein the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set;

whereby the presence or absence of the chromosome abnormality is determined based on the amount of the amplified nucleic acid species from two or more sets; and b. transmitting the presence or absence of the chromosomal abnormality to the pregnant female subject.

H2. A method for transmitting prenatal genetic information to a human pregnant female subject, which comprises:
  a. identifying the presence or absence of a chromosomal abnormality in the fetus of the pregnant female subject, wherein the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set;
whereby the presence or absence of the chromosome abnormality is determined based on the amount of the amplified nucleic acid species from two or more sets; and
  b. transmitting prenatal genetic information representing the chromosome number in cells in the fetus to the pregnant female subject.

I1. A method for providing to a human pregnant female subject a medical prescription based on prenatal genetic information, which comprises:
  a. identifying the presence or absence of a chromosomal abnormality in the fetus of the pregnant female subject, wherein the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set;
whereby the presence or absence of the chromosome abnormality is determined based on the amount of the amplified nucleic acid species from two or more sets; and
  b. providing a medical prescription based on the presence or absence of the chromosomal abnormality to the pregnant female subject.

I2. A method for providing to a human pregnant female subject a medical prescription based on prenatal genetic information, which comprises:
  a. reporting to a pregnant female subject the presence or absence of a chromosomal abnormality in the fetus of the pregnant female subject, wherein the presence or absence of the chromosomal abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets; and
  b. providing a medical prescription based on the presence or absence of the chromosome abnormality to the pregnant female subject.

I3. The method of embodiment I1 or I2, wherein the medical prescription is for the pregnant female subject to undergo an amniocentesis procedure.

I4. The method of embodiment I1 or I2, wherein the medical prescription is for the pregnant female subject to undergo another genetic test.

I5. The method of embodiment I1 or I2, wherein the medical prescription is medical advice to not undergo further genetic testing.

J1. A file comprising the presence or absence of a chromosome abnormality in the fetus of a pregnant female subject, wherein the presence or absence of the chromosome abnormality has been determined by preparing a plurality of sets of amplified nucleic acid species by amplifying a plurality of nucleotide sequence sets from extracellular nucleic acid template from placenta-expressed nucleic acid in the blood of the pregnant female subject, of a subject, wherein: (i) the extracellular nucleic acid template is heterogenous, (ii) each nucleotide sequence in a set is present on two or more different chromosomes, (iii) each nucleotide sequence in a set differs by one or more mismatch nucleotides from each other nucleotide sequence in the set; (iv) each nucleotide sequence in a set is amplified at a substantially reproducible level relative to each other nucleotide sequence in the set, (v) the primer hybridization sequences in the extracellular nucleic acid template are substantially identical; and (vi) each amplified nucleic acid species in a set comprises a nucleotide sequence having the one or more mismatch nucleotides; and determining the amount of each amplified nucleic acid species in each set; whereby the presence or absence of the chromosome abnormality is determined based on the amount of the amplified nucleic acid species from two or more sets.

J2. The file of embodiment J1, which is a computer readable file.

J3. The file of embodiment J1, which is a paper file.

J4. The file of embodiment J1, which is a medical record file.

The entirety of each patent, patent application, publication and document referenced herein hereby is incorporated by reference. Citation of the above patents, patent applications, publications and documents is not an admission that any of the foregoing is pertinent prior art, nor does it constitute any admission as to the contents or date of these publications or documents.

Modifications may be made to the foregoing without departing from the basic aspects of the technology. Although the technology has been described in substantial detail with reference to one or more specific embodiments, those of ordinary skill in the art will recognize that changes may be made to the embodiments specifically disclosed in this application, yet these modifications and improvements are within the scope and spirit of the technology.

The technology illustratively described herein suitably may be practiced in the absence of any element(s) not specifically disclosed herein. Thus, for example, in each instance herein any of the terms "comprising," "consisting essentially of," and "consisting of" may be replaced with either of the other two terms. The terms and expressions which have been employed are used as terms of description and not of limitation, and use of such terms and expressions do not exclude any equivalents of the features shown and described or portions thereof, and various modifications are possible within the scope of the technology claimed. The term "a" or "an" can refer to one of or a plurality of the elements it modifies (e.g., "a reagent" can mean one or more reagents) unless it is contextually clear either one of the elements or more than one of the elements is described. The term "about" as used herein refers to a value within 10% of the underlying parameter (i.e., plus or minus 10%), and use of the term "about" at the beginning of a string of values modifies each of the values (i.e., "about 1, 2 and 3" is about 1, about 2 and about 3). For example, a weight of "about 100 grams" can include weights between 90 grams and 110 grams. Further, when a listing of values is described herein (e.g., 50%, 60%, 70%, 80%, 85%, 86%, 87%, 88%, 89%, 90%, 91%, 92%, 93% or 94%), the listing includes all intermediate values thereof (e.g., 62%, 77%). Thus, it should be understood that although the present technology has been specifically disclosed by representative embodiments and optional features, modification and variation of the concepts herein disclosed may be resorted to by those skilled in the art, and such modifications and variations are considered within the scope of this technology.

Non-limiting embodiments of the technology are set forth in the claim that follows.

LENGTHY TABLES

The patent contains a lengthy table section. A copy of the table is available in electronic form from the USPTO web site (http://seqdata.uspto.gov/?pageRequest=docDetail&DocID=US09926593B2). An electronic copy of the table will also be available from the USPTO upon request and payment of the fee set forth in 37 CFR 1.19(b)(3).

SEQUENCE LISTING (5179 sequences)

SEQ ID NO: 1 - DNA, 10 bp, Artificial Sequence
  Description of Artificial Sequence: Synthetic oligonucleotide
acgttggatg

SEQ ID NO: 2 - DNA, 19 bp, Artificial Sequence
  Description of Artificial Sequence: Synthetic primer
ggtttggatgatgtgttgc

SEQ ID NO: 3 - DNA, 20 bp, Artificial Sequence
  Description of Artificial Sequence: Synthetic primer
tgatgatgggccaggaaatg

SEQ ID NO: 4 - DNA, 20 bp, Artificial Sequence
  Description of Artificial Sequence: Synthetic primer
attggctgtaacaaatgctg

SEQ ID NO: 5 - DNA, 20 bp, Artificial Sequence
  Description of Artificial Sequence: Synthetic primer
ataccctcctgcatgcttag

SEQ ID NO: 6 - DNA, 20 bp, Artificial Sequence
  Description of Artificial Sequence: Synthetic primer
cagcaaggttgaaattggga

SEQ ID NO: 7 - DNA, 20 bp, Artificial Sequence
  Description of Artificial Sequence: Synthetic primer
gggccagtaccatttcatag

SEQ ID NO: 8 - DNA, 20 bp, Artificial Sequence
  Description of Artificial Sequence: Synthetic primer
tcatagaatgcccatttgtg

SEQ ID NO: 9 - DNA, 20 bp, Artificial Sequence
  Description of Artificial Sequence: Synthetic primer
gccttatcctgtatcctagc

SEQ ID NO: 10 - DNA, 20 bp, Artificial Sequence
  Description of Artificial Sequence: Synthetic primer
tcccaatttcaaccttgctg

SEQ ID NO: 11 - DNA, 19 bp, Artificial Sequence
  Description of Artificial Sequence: Synthetic primer
tgtaagattttgttccctc

SEQ ID NO: 12 - DNA, 20 bp, Artificial Sequence
  Description of Artificial Sequence: Synthetic primer
cacctagcttgagaaggatg

SEQ ID NO: 13 - DNA, 20 bp, Artificial Sequence
  Description of Artificial Sequence: Synthetic primer
cacctagcttgagaaggatg

SEQ ID NO: 14 - DNA, 20 bp, Artificial Sequence
  Description of Artificial Sequence: Synthetic primer
aagaagttcttctgggtctg

SEQ ID NO: 15 - DNA, 19 bp, Artificial Sequence
  Description of Artificial Sequence: Synthetic primer
ttttcatacacttctctgg

SEQ ID NO: 16 - DNA, 20 bp, Artificial Sequence
  Description of Artificial Sequence: Synthetic primer
cagtggcaaaatacctcaag

SEQ ID NO: 17 - DNA, 20 bp, Artificial Sequence
  Description of Artificial Sequence: Synthetic primer
cagtggcaaaatacctcaag

SEQ ID NO: 18 - DNA, 20 bp, Artificial Sequence
  Description of Artificial Sequence: Synthetic primer
ctccctccccagtagaaata

SEQ ID NO: 19 - DNA, 20 bp, Artificial Sequence
  Description of Artificial Sequence: Synthetic primer
atccaagatactcactttcc

SEQ ID NO: 20 - DNA, 21 bp, Artificial Sequence
  Description of Artificial Sequence: Synthetic primer
ctttcattgcaaaatgtttcc

SEQ ID NO: 21 - DNA, 18 bp, Artificial Sequence
  Description of Artificial Sequence: Synthetic primer
agattctctggtcacagg

SEQ ID NO: 22 - DNA, 20 bp, Artificial Sequence
  Description of Artificial Sequence: Synthetic primer
gaggcaactaggacttaagg

SEQ ID NO: 23 - DNA, 19 bp, Artificial Sequence
  Description of Artificial Sequence: Synthetic primer
gtactcaaatcaaattggc

SEQ ID NO: 24 - DNA, 20 bp, Artificial Sequence
  Description of Artificial Sequence: Synthetic primer
ggtgaaggctgtatttgtag

SEQ ID NO: 25 - DNA, 20 bp, Artificial Sequence
  Description of Artificial Sequence: Synthetic primer
ccagccaagaatacaaacac

SEQ ID NO: 26 - DNA, 20 bp, Artificial Sequence
  Description of Artificial Sequence: Synthetic primer
ccagccaagaatacaaacac

SEQ ID NO: 27 - DNA, 20 bp, Artificial Sequence
  Description of Artificial Sequence: Synthetic primer
attaagaagtttgctgaggc

SEQ ID NO: 28 - DNA, 20 bp, Artificial Sequence
  Description of Artificial Sequence: Synthetic primer
cattggccttaactccagag

SEQ ID NO: 29 - DNA, 20 bp, Artificial Sequence
  Description of Artificial Sequence: Synthetic primer
agaactttgaaagtattaac

SEQ ID NO: 30 - DNA, 20 bp, Artificial Sequence
  Description of Artificial Sequence: Synthetic primer
gctattgctgatactggtgc

SEQ ID NO: 31 - DNA, 21 bp, Artificial Sequence
  Description of Artificial Sequence: Synthetic primer
ggaacagtgttgataaagact

SEQ ID NO: 32 - DNA, 20 bp, Artificial Sequence
  Description of Artificial Sequence: Synthetic primer
agcttggccagaaatacttc

SEQ ID NO: 33 - DNA, 21 bp, Artificial Sequence
  Description of Artificial Sequence: Synthetic primer
gcagaaaagctcatgagattc

SEQ ID NO: 34 - DNA, 21 bp, Artificial Sequence
  Description of Artificial Sequence: Synthetic primer
gcagaaaagctcatgagattc

SEQ ID NO: 35 - DNA, 20 bp, Artificial Sequence
  Description of Artificial Sequence: Synthetic primer
atctcgaaggttttttgcag

SEQ ID NO: 36 - DNA, 20 bp, Artificial Sequence
  Description of Artificial Sequence: Synthetic primer
cattcatcagaatgtgaccc

SEQ ID NO: 37 - DNA, 21 bp, Artificial Sequence
  Description of Artificial Sequence: Synthetic primer
cattacccccttattattttg

SEQ ID NO: 38 - DNA, 20 bp, Artificial Sequence
  Description of Artificial Sequence: Synthetic primer
agtcggagtcatactccaag

SEQ ID NO: 39 - DNA, 20 bp, Artificial Sequence
  Description of Artificial Sequence: Synthetic primer
ctgtggtaagaagacgaagc

SEQ ID NO: 40 - DNA, 20 bp, Artificial Sequence
  Description of Artificial Sequence: Synthetic primer
ggatgggagatctgctaaac

SEQ ID NO: 41 - DNA, 20 bp, Artificial Sequence
  Description of Artificial Sequence: Synthetic primer
aggtgcaggctttaggtttg

SEQ ID NO: 42 - DNA, 20 bp, Artificial Sequence
  Description of Artificial Sequence: Synthetic primer
taatgcagctgccatgtgtg

SEQ ID NO: 43 - DNA, 21 bp, Artificial Sequence
  Description of Artificial Sequence: Synthetic primer
ctcagttagttcttctatagt

SEQ ID NO: 44 - DNA, 18 bp, Artificial Sequence
  Description of Artificial Sequence: Synthetic primer
attgctgcagcaaaacca

SEQ ID NO: 45 - DNA, 20 bp, Artificial Sequence
  Description of Artificial Sequence: Synthetic primer
cattctccataaacactatc

SEQ ID NO: 46 - DNA, 20 bp, Artificial Sequence
  Description of Artificial Sequence: Synthetic primer
ctctacagcaatgagtgaac

SEQ ID NO: 47 - DNA, 21 bp, Artificial Sequence
  Description of Artificial Sequence: Synthetic primer
cctgagctctatttaacatgc

SEQ ID NO: 48 - DNA, 20 bp, Artificial Sequence
  Description of Artificial Sequence: Synthetic primer
tcagggccactatcatggac

SEQ ID NO: 49 - DNA, 20 bp, Artificial Sequence
  Description of Artificial Sequence: Synthetic primer
tcctgtgtctgctttgatgg

SEQ ID NO: 50 - DNA, 20 bp, Artificial Sequence
  Description of Artificial Sequence: Synthetic primer
ttataaaacctcaatctatc

SEQ ID NO: 51 - DNA, 20 bp, Artificial Sequence
  Description of Artificial Sequence: Synthetic primer
ggtacaaaaatcaaagcctg

SEQ ID NO: 52 - DNA, 19 bp, Artificial Sequence
  Description of Artificial Sequence: Synthetic primer
tcgtttggatgttagccac

SEQ ID NO: 53 - DNA, 20 bp, Artificial Sequence
  Description of Artificial Sequence: Synthetic primer
agtggctaacatccaaacga

SEQ ID NO: 54 - DNA, 20 bp, Artificial Sequence
  Description of Artificial Sequence: Synthetic primer
gtactatgatgtaactcccc

SEQ ID NO: 55 - DNA, 20 bp, Artificial Sequence
  Description of Artificial Sequence: Synthetic primer
gtaatcagtgaagggctgtg

SEQ ID NO: 56 - DNA, 20 bp, Artificial Sequence
  Description of Artificial Sequence: Synthetic primer
cttgatcacctcaataacac

SEQ ID NO: 57 - DNA, 21 bp, Artificial Sequence
  Description of Artificial Sequence: Synthetic primer
caaaattttgaggggagatgg

SEQ ID NO: 58 - DNA, 20 bp, Artificial Sequence
  Description of Artificial Sequence: Synthetic primer
tgggttctgctggacagata

SEQ ID NO: 59 - DNA, 20 bp, Artificial Sequence
  Description of Artificial Sequence: Synthetic primer
gtaaaactatatcacaactc

SEQ ID NO: 60 - DNA, 20 bp, Artificial Sequence
  Description of Artificial Sequence: Synthetic primer
gtggctggttgccaatttta

SEQ ID NO: 61 - DNA, 20 bp, Artificial Sequence
  Description of Artificial Sequence: Synthetic primer
attggcaaccagccactatt

SEQ ID NO: 62 - DNA, 20 bp, Artificial Sequence
  Description of Artificial Sequence: Synthetic primer
atttgggccttaagcttttg

SEQ ID NO: 63 - DNA, 20 bp, Artificial Sequence
  Description of Artificial Sequence: Synthetic primer
ctgttgtaaggggaaaagtc

SEQ ID NO: 64 - DNA, 20 bp, Artificial Sequence
  Description of Artificial Sequence: Synthetic primer
gaggctcagtagaggtttag

SEQ ID NO: 65 - DNA, 20 bp, Artificial Sequence
  Description of Artificial Sequence: Synthetic primer
cataggtttgaagcagtcac

SEQ ID NO: 66 - DNA, 20 bp, Artificial Sequence
  Description of Artificial Sequence: Synthetic primer
acagtgtcctgattagtgcc

SEQ ID NO: 67 - DNA, 19 bp, Artificial Sequence
  Description of Artificial Sequence: Synthetic primer
aattttatagagaagcctg

SEQ ID NO: 68 - DNA, 20 bp, Artificial Sequence
  Description of Artificial Sequence: Synthetic primer
caccttaccctgccatcaag

SEQ ID NO: 69 - DNA, 21 bp, Artificial Sequence
  Description of Artificial Sequence: Synthetic primer
cataggtgagaaaagtttggg

SEQ ID NO: 70 - DNA, 20 bp, Artificial Sequence
  Description of Artificial Sequence: Synthetic primer
ctcttccagagtgttctcta

SEQ ID NO: 71 - DNA, 20 bp, Artificial Sequence
  Description of Artificial Sequence: Synthetic primer
ccctacactccttcttcttt

SEQ ID NO: 72 - DNA, 20 bp, Artificial Sequence
  Description of Artificial Sequence: Synthetic primer
ttccccaaacttttctcacc

SEQ ID NO: 73 - DNA, 20 bp, Artificial Sequence
  Description of Artificial Sequence: Synthetic primer
ctcactgtacatccatcctc

SEQ ID NO: 74 - DNA, 20 bp, Artificial Sequence
  Description of Artificial Sequence: Synthetic primer
aaagaagaaggagtgtaggg

SEQ ID NO: 75 - DNA, 18 bp, Artificial Sequence
  Description of Artificial Sequence: Synthetic primer
gcagagatatcatgcaca

SEQ ID NO: 76 - DNA, 19 bp, Artificial Sequence
  Description of Artificial Sequence: Synthetic primer
ggcatggggctttcttgct

SEQ ID NO: 77 - DNA, 19 bp, Artificial Sequence
  Description of Artificial Sequence: Synthetic primer
gcctctcaggcaccattct

SEQ ID NO: 78 - DNA, 20 bp, Artificial Sequence
  Description of Artificial Sequence: Synthetic primer
ccattgccaaagttgtggtt

SEQ ID NO: 79 - DNA, 20 bp, Artificial Sequence
  Description of Artificial Sequence: Synthetic primer
gagtccaaggagaattccac

SEQ ID NO: 80 - DNA, 20 bp, Artificial Sequence
  Description of Artificial Sequence: Synthetic primer
tggtgacaaggtgaaaaggg

SEQ ID NO: 81 - DNA, 19 bp, Artificial Sequence
  Description of Artificial Sequence: Synthetic primer
cataagccactttttcaga

SEQ ID NO: 82 - DNA, 19 bp, Artificial Sequence
  Description of Artificial Sequence: Synthetic primer
aagcaccttgggaattttt

SEQ ID NO: 83 - DNA, 20 bp, Artificial Sequence
  Description of Artificial Sequence: Synthetic primer
acacagattcctcccatagc

SEQ ID NO: 84 - DNA, 20 bp, Artificial Sequence
  Description of Artificial Sequence: Synthetic primer
ttgtggagtaggcatatttc

SEQ ID NO: 85 - DNA, 19 bp, Artificial Sequence
  Description of Artificial Sequence: Synthetic primer
gggattccattatctggtc

SEQ ID NO: 86 - DNA, 21 bp, Artificial Sequence
  Description of Artificial Sequence: Synthetic primer
cctgagttttaagtgccacat

SEQ ID NO: 87 - DNA, 19 bp, Artificial Sequence
  Description of Artificial Sequence: Synthetic primer
agactttttgtacagtaag

SEQ ID NO: 88 - DNA, 20 bp, Artificial Sequence
  Description of Artificial Sequence: Synthetic primer
gttttctaattttctggatg

SEQ ID NO: 89 - DNA, 20 bp, Artificial Sequence
  Description of Artificial Sequence: Synthetic primer
cagtggaatcctgggaaatt

SEQ ID NO: 90 - DNA, 20 bp, Artificial Sequence
  Description of Artificial Sequence: Synthetic primer
aaactaacagcctggaatac

SEQ ID NO: 91 - DNA, 20 bp, Artificial Sequence
  Description of Artificial Sequence: Synthetic primer
ctaatttttagaaagagtac

SEQ ID NO: 92 - DNA, 20 bp, Artificial Sequence
  Description of Artificial Sequence: Synthetic primer
agtggcagaagatggaatag

SEQ ID NO: 93 - DNA, 20 bp, Artificial Sequence
  Description of Artificial Sequence: Synthetic primer
tatggtgctaaaaaggactg

SEQ ID NO: 94 - DNA, 20 bp, Artificial Sequence
  Description of Artificial Sequence: Synthetic primer
actattccatcttctgccac

SEQ ID NO: 95 - DNA, 20 bp, Artificial Sequence
  Description of Artificial Sequence: Synthetic primer
acatcatatagaaagggcag

SEQ ID NO: 96 - DNA, 20 bp, Artificial Sequence
  Description of Artificial Sequence: Synthetic primer
caaactgtaaacagtggtcc

SEQ ID NO: 97 - DNA, 20 bp, Artificial Sequence
  Description of Artificial Sequence: Synthetic primer
tttagagctcttgcatcttg

SEQ ID NO: 98 - DNA, 20 bp, Artificial Sequence
  Description of Artificial Sequence: Synthetic primer
tggcactttcctcacatttg

SEQ ID NO: 99 - DNA, 20 bp, Artificial Sequence
  Description of Artificial Sequence: Synthetic primer
gaaaaaagtgcatgtctttg

SEQ ID NO: 100 - DNA, 20 bp, Artificial Sequence
  Description of Artificial Sequence: Synthetic primer
agattatgatgcactggcct

SEQ ID NO: 101 - DNA, 20 bp, Artificial Sequence
  Description of Artificial Sequence: Synthetic primer
gaaaaaagtgcatgtctttg

SEQ ID NO: 102 - DNA, 20 bp, Artificial Sequence
  Description of Artificial Sequence: Synthetic primer
gattatgatgcactggcctg

SEQ ID NO: 103 - DNA, 20 bp, Artificial Sequence
  Description of Artificial Sequence: Synthetic primer
attaatacaagggggtgttc

SEQ ID NO: 104 - DNA, 20 bp, Artificial Sequence
  Description of Artificial Sequence: Synthetic primer
gtctaccaaactacaattag

SEQ ID NO: 105 - DNA, 20 bp, Artificial Sequence
  Description of Artificial Sequence: Synthetic primer
gcatgttgccatttttacac

SEQ ID NO: 106 - DNA, 19 bp, Artificial Sequence
  Description of Artificial Sequence: Synthetic primer
ccaaattttcaagcaaagc

SEQ ID NO: 107 - DNA, 19 bp, Artificial Sequence
  Description of Artificial Sequence: Synthetic primer
ggagttgacaattacatct

SEQ ID NO: 108 - DNA, 20 bp, Artificial Sequence
  Description of Artificial Sequence: Synthetic primer
ggaaagttagaaggccacac

SEQ ID NO: 109 - DNA, 20 bp, Artificial Sequence
  Description of Artificial Sequence: Synthetic primer
gattgtgggtttttggaaag

SEQ ID NO: 110 - DNA, 20 bp, Artificial Sequence
  Description of Artificial Sequence: Synthetic primer
ctttccaaaaacccacaatc

SEQ ID NO: 111 - DNA, 20 bp, Artificial Sequence
  Description of Artificial Sequence: Synthetic primer
tgtctctggcattccctatc

SEQ ID NO: 112 - DNA, 19 bp, Artificial Sequence
  Description of Artificial Sequence: Synthetic primer
agggctgcagggacagtag

SEQ ID NO: 113 - DNA, 21 bp, Artificial Sequence
  Description of Artificial Sequence: Synthetic primer
gtttgccagttcaaattcagc

SEQ ID NO: 114 - DNA, 19 bp, Artificial Sequence
  Description of Artificial Sequence: Synthetic primer
tagtgatatgaagatcaca

SEQ ID NO: 115 - DNA, 20 bp, Artificial Sequence
  Description of Artificial Sequence: Synthetic primer
tagtcataggtgtcctatgg

SEQ ID NO: 116 - DNA, 21 bp, Artificial Sequence
  Description of Artificial Sequence: Synthetic primer
ctgaataattaaaactttggc

SEQ ID NO: 117 - DNA, 21 bp, Artificial Sequence
  Description of Artificial Sequence: Synthetic primer
gaaagaaaaggtgctctacag

SEQ ID NO: 118 - DNA, 20 bp, Artificial Sequence
  Description of Artificial Sequence: Synthetic primer
ggcaatgagttccataagtt

SEQ ID NO: 119 - DNA, 19 bp, Artificial Sequence
  Description of Artificial Sequence: Synthetic primer
tctgatttatactgaggac

SEQ ID NO: 120 - DNA, 19 bp, Artificial Sequence
  Description of Artificial Sequence: Synthetic primer
tctcctcactgtgcacagg

SEQ ID NO: 121 - DNA, 19 bp, Artificial Sequence
  Description of Artificial Sequence: Synthetic primer
cacacctggttgtcagcac

SEQ ID NO: 122 - DNA, 19 bp, Artificial Sequence
  Description of Artificial Sequence: Synthetic primer
ttgttgctccaagtttaag

SEQ ID NO: 123 - DNA, 20 bp, Artificial Sequence
  Description of Artificial Sequence: Synthetic primer
gattattttggtactaacaa

SEQ ID NO: 124 - DNA, 18 bp, Artificial Sequence
  Description of Artificial Sequence: Synthetic primer
ggccggggccagggcttt

SEQ ID NO: 125 - DNA, 19 bp, Artificial Sequence
  Description of Artificial Sequence: Synthetic primer
tgccaaacagcagacgcag

SEQ ID NO: 126 - DNA, 20 bp, Artificial Sequence
  Description of Artificial Sequence: Synthetic primer
tgacagagaagggctgcaag

SEQ ID NO: 127 - DNA, 20 bp, Artificial Sequence
  Description of Artificial Sequence: Synthetic primer
ggagaaactgacagagaagg

SEQ ID NO: 128 - DNA, 20 bp, Artificial Sequence
  Description of Artificial Sequence: Synthetic primer
cccgatgggaactctcattt

SEQ ID NO: 129 - DNA, 20 bp, Artificial Sequence
  Description of Artificial Sequence: Synthetic primer
agcccttctctgtcagtttc

SEQ ID NO: 130 - DNA, 20 bp, Artificial Sequence
  Description of Artificial Sequence: Synthetic primer
atggctaggatgccccagac

SEQ ID NO: 131 - DNA, 19 bp, Artificial Sequence
  Description of Artificial Sequence: Synthetic primer
ggtggtgggcagcatctgg

SEQ ID NO: 132 - DNA, 20 bp, Artificial Sequence
  Description of Artificial Sequence: Synthetic primer
aaggatagaacaaggtcccg

SEQ ID NO: 133 - DNA, 20 bp, Artificial Sequence
  Description of Artificial Sequence: Synthetic primer
gggacattattagcaaggag

SEQ ID NO: 134 - DNA, 20 bp, Artificial Sequence
  Description of Artificial Sequence: Synthetic primer
cagggtccttttcttttggg

SEQ ID NO: 135 - DNA, 20 bp, Artificial Sequence
  Description of Artificial Sequence: Synthetic primer
tcaggaagaaacagtcaggc

SEQ ID NO: 136 - DNA, 20 bp, Artificial Sequence
  Description of Artificial Sequence: Synthetic primer
ttccagcctgaggctgtttc

SEQ ID NO: 137 - DNA, 20 bp, Artificial Sequence
  Description of Artificial Sequence: Synthetic primer
ccattgaagcattcagcagg

SEQ ID NO: 138 - DNA, 19 bp, Artificial Sequence
  Description of Artificial Sequence: Synthetic primer
agcaagggaggctgcccag

SEQ ID NO: 139 - DNA, 20 bp, Artificial Sequence
  Description of Artificial Sequence: Synthetic primer
agtgtctgcagttttctggg

SEQ ID NO: 140 - DNA, 20 bp, Artificial Sequence
  Description of Artificial Sequence: Synthetic primer
gatgagcagctcgcaatagg

SEQ ID NO: 141 - DNA, 19 bp, Artificial Sequence
  Description of Artificial Sequence: Synthetic primer
ctctccggccaggcctctc

SEQ ID NO: 142 - DNA, 19 bp, Artificial Sequence
  Description of Artificial Sequence: Synthetic primer
ctctccggccaggcctctc

SEQ ID NO: 143 - DNA, 20 bp, Artificial Sequence
  Description of Artificial Sequence: Synthetic primer
tcttaagcccttgccccctg

SEQ ID NO: 144 - DNA, 20 bp, Artificial Sequence
  Description of Artificial Sequence: Synthetic primer
gatccctatctctgtctgcg

SEQ ID NO: 145 - DNA, 20 bp, Artificial Sequence
  Description of Artificial Sequence: Synthetic primer
agagatagggatcgctccag

SEQ ID NO: 146 - DNA, 19 bp, Artificial Sequence
  Description of Artificial Sequence: Synthetic primer
tcatgtggggctggtgtag

SEQ ID NO: 147 - DNA, 20 bp, Artificial Sequence
  Description of Artificial Sequence: Synthetic primer
aggaggaggagcccacactg

SEQ ID NO: 148 - DNA, 19 bp, Artificial Sequence
  Description of Artificial Sequence: Synthetic primer
ggtcaaaggtcctgcacac

SEQ ID NO: 149 - DNA, 20 bp, Artificial Sequence
  Description of Artificial Sequence: Synthetic primer
caagagttcagatgagtggc

SEQ ID NO: 150 - DNA, 20 bp, Artificial Sequence
  Description of Artificial Sequence: Synthetic primer
ggagtgctttctttgcaact

SEQ ID NO: 151 - DNA, 19 bp, Artificial Sequence
  Description of Artificial Sequence: Synthetic primer
aaggaaatcagcagtgata

SEQ ID NO: 152 - DNA, 20 bp, Artificial Sequence
  Description of Artificial Sequence: Synthetic primer
tggctgaaggaagcccgaat

SEQ ID NO: 153 - DNA, 20 bp, Artificial Sequence
  Description of Artificial Sequence: Synthetic primer
tttgtcaatcagctgaaggg

SEQ ID NO: 154 - DNA, 20 bp, Artificial Sequence
  Description of Artificial Sequence: Synthetic primer
cccttcagctgattgacaaa

SEQ ID NO: 155 - DNA, 20 bp, Artificial Sequence
  Description of Artificial Sequence: Synthetic primer
gaagtactggtacaagctat

SEQ ID NO: 156 - DNA, 20 bp, Artificial Sequence
  Description of Artificial Sequence: Synthetic primer
cagtgaagagacccttagag

SEQ ID NO: 157 - DNA, 20 bp, Artificial Sequence
  Description of Artificial Sequence: Synthetic primer
caatcattgctacccttcgg

SEQ ID NO: 158 - DNA, 19 bp, Artificial Sequence
  Description of Artificial Sequence: Synthetic primer
cagctatccctccagagtc

SEQ ID NO: 159 - DNA, 20 bp, Artificial Sequence
  Description of Artificial Sequence: Synthetic primer
gccatcaaagccaactgttc

SEQ ID NO: 160 - DNA, 20 bp, Artificial Sequence
  Description of Artificial Sequence: Synthetic primer
cagaacagttggctttgatg

SEQ ID NO: 161 - DNA, 20 bp, Artificial Sequence
  Description of Artificial Sequence: Synthetic primer
taatgcctccactgaaagcc

SEQ ID NO: 162 - DNA, 20 bp, Artificial Sequence
  Description of Artificial Sequence: Synthetic primer
agctctctgttcagctgatc

SEQ ID NO: 163 - DNA, 20 bp, Artificial Sequence
  Description of Artificial Sequence: Synthetic primer
cctttttgaccacattatcc

SEQ ID NO: 164 - DNA, 20 bp, Artificial Sequence
  Description of Artificial Sequence: Synthetic primer
gttggagtgtgcattgacag

SEQ ID NO: 165 - DNA, 20 bp, Artificial Sequence
  Description of Artificial Sequence: Synthetic primer
tgtttttggagttgtgaggc

SEQ ID NO: 166 - DNA, 20 bp, Artificial Sequence
  Description of Artificial Sequence: Synthetic primer
actcagacaaactcttcgag

SEQ ID NO: 167 - DNA, 19 bp, Artificial Sequence
  Description of Artificial Sequence: Synthetic primer
ggcaatggaacattataag

SEQ ID NO: 168 - DNA, 22 bp, Artificial Sequence
  Description of Artificial Sequence: Synthetic primer
gtataaataatgttcagttatc

SEQ ID NO: 169 - DNA, 21 bp, Artificial Sequence
  Description of Artificial Sequence: Synthetic primer
gtaaaatcttgtaagttgcag

SEQ ID NO: 170 - DNA, 20 bp, Artificial Sequence
  Description of Artificial Sequence: Synthetic primer
aggtgcaactccaaaaaagc

SEQ ID NO: 171 - DNA, 20 bp, Artificial Sequence
  Description of Artificial Sequence: Synthetic primer
cttgaaccagtggttctggc

SEQ ID NO: 172 - DNA, 20 bp, Artificial Sequence
  Description of Artificial Sequence: Synthetic primer
ggagttgcacctgttccttg

SEQ ID NO: 173 - DNA, 20 bp, Artificial Sequence
  Description of Artificial Sequence: Synthetic primer
ttgtggaggattatttctgc

SEQ ID NO: 174 - DNA, 20 bp, Artificial Sequence
  Description of Artificial Sequence: Synthetic primer
agaatctcctcacaccttgc

SEQ ID NO: 175 - DNA, 18 bp, Artificial Sequence
  Description of Artificial Sequence: Synthetic primer
aggactctgcaacccagg

SEQ ID NO: 176 - DNA, 19 bp, Artificial Sequence
  Description of Artificial Sequence: Synthetic primer
ctatagaaattactggact

SEQ ID NO: 177 - DNA, 20 bp, Artificial Sequence
  Description of Artificial Sequence: Synthetic primer
cactcagaatgattccttcc

SEQ ID NO: 178 - DNA, 19 bp, Artificial Sequence
  Description of Artificial Sequence: Synthetic primer
acatgtccaaatatgtctg

SEQ ID NO: 179 - DNA, 21 bp, Artificial Sequence
  Description of Artificial Sequence: Synthetic primer
tatttttatttccaatgtagt

SEQ ID NO: 180 - DNA, 20 bp, Artificial Sequence
  Description of Artificial Sequence: Synthetic primer
tcatccccatttctcaactc

SEQ ID NO: 181 - DNA, 18 bp, Artificial Sequence
  Description of Artificial Sequence: Synthetic primer
atcaaagccattagccta

SEQ ID NO: 182 - DNA, 20 bp, Artificial Sequence
  Description of Artificial Sequence: Synthetic primer
tcaaaagtgctggccaggtc

SEQ ID NO: 183 - DNA, 20 bp, Artificial Sequence
  Description of Artificial Sequence: Synthetic primer
ctttggtgtctttatccctg

SEQ ID NO: 184 - DNA, 20 bp, Artificial Sequence
  Description of Artificial Sequence: Synthetic primer
gacctggccagcacttttga

SEQ ID NO: 185 - DNA, 20 bp, Artificial Sequence
  Description of Artificial Sequence: Synthetic primer
gacctggccagcacttttga

SEQ ID NO: 186 - DNA, 21 bp, Artificial Sequence
  Description of Artificial Sequence: Synthetic primer
gttaaggtgttctaaggctac

SEQ ID NO: 187 - DNA, 19 bp, Artificial Sequence
  Description of Artificial Sequence: Synthetic primer
ttcctctaaattccttagc

SEQ ID NO: 188 - DNA, 19 bp, Artificial Sequence
  Description of Artificial Sequence: Synthetic primer
tcaatatcttacagtacag

SEQ ID NO: 189 - DNA, 20 bp, Artificial Sequence
  Description of Artificial Sequence: Synthetic primer
gaggttcaattttatttcat

SEQ ID NO: 190 - DNA, 18 bp, Artificial Sequence
  Description of Artificial Sequence: Synthetic primer
tagttgccctgagttcaa

SEQ ID NO: 191 - DNA, 20 bp, Artificial Sequence
  Description of Artificial Sequence: Synthetic primer
gctgatcaaggcagtttttc

SEQ ID NO: 192 - DNA, 19 bp, Artificial Sequence
  Description of Artificial Sequence: Synthetic primer
catggtgtcctccatgcag

SEQ ID NO: 193 - DNA, 20 bp, Artificial Sequence
  Description of Artificial Sequence: Synthetic primer
gagctgatggtgatccagac

SEQ ID NO: 194 - DNA, 20 bp, Artificial Sequence
  Description of Artificial Sequence: Synthetic primer
actgcaaccacagctggaac

SEQ ID NO: 195 - DNA, 20 bp, Artificial Sequence
  Description of Artificial Sequence: Synthetic primer
tgcaaccacagctggaacac

SEQ ID NO: 196 - DNA, 20 bp, Artificial Sequence
  Description of Artificial Sequence: Synthetic primer
attcctggtcttggcagatg

SEQ ID NO: 197 - DNA, 20 bp, Artificial Sequence
  Description of Artificial Sequence: Synthetic primer
tcaggccacgacttctgtgc

SEQ ID NO: 198 - DNA, 20 bp, Artificial Sequence
  Description of Artificial Sequence: Synthetic primer
agcccatgaaggcttccaaa

SEQ ID NO: 199 - DNA, 20 bp, Artificial Sequence
  Description of Artificial Sequence: Synthetic primer
cttgttgcctggttttcatt

SEQ ID NO: 200 - DNA, 19 bp, Artificial Sequence
  Description of Artificial Sequence: Synthetic primer
tgtgagcctgggctccctg

SEQ ID NO: 201 - DNA, 20 bp, Artificial Sequence
  Description of Artificial Sequence: Synthetic primer
gtaggcaagctcatgcattc

SEQ ID NO: 202 - DNA, 21 bp, Artificial Sequence
  Description of Artificial Sequence: Synthetic primer
ctatgtggaatacaaaatgcc

SEQ ID NO: 203 - DNA, 19 bp, Artificial Sequence
  Description of Artificial Sequence: Synthetic primer
taaagatgatttcccaagt

SEQ ID NO: 204 - DNA, 19 bp, Artificial Sequence
  Description of Artificial Sequence: Synthetic primer
tatcaagtactttgtccat

SEQ ID NO: 205 - DNA, 20 bp, Artificial Sequence
  Description of Artificial Sequence: Synthetic primer
gcctcattctctgcattcac

SEQ ID NO: 206 - DNA, 20 bp, Artificial Sequence
  Description of Artificial Sequence: Synthetic primer
tcgtgtggatacagtactgc

SEQ ID NO: 207 - DNA, 20 bp, Artificial Sequence
  Description of Artificial Sequence: Synthetic primer
catggtcagtgaatgcagag

SEQ ID NO: 208 - DNA, 19 bp, Artificial Sequence
  Description of Artificial Sequence: Synthetic primer
tgcttttaaagacatcagg

SEQ ID NO: 209 - DNA, 19 bp, Artificial Sequence
  Description of Artificial Sequence: Synthetic primer
cttctgatgaaaccaaatc

SEQ ID NO: 210 - DNA, 20 bp, Artificial Sequence
  Description of Artificial Sequence: Synthetic primer
aaattaatggatttgacatc

SEQ ID NO: 211 - DNA, 20 bp, Artificial Sequence
  Description of Artificial Sequence: Synthetic primer
aactgagataggtgggaaac

SEQ ID NO: 212 - DNA, 19 bp, Artificial Sequence
  Description of Artificial Sequence: Synthetic primer
gaaaagcatcatagttctg

SEQ ID NO: 213 - DNA, 21 bp, Artificial Sequence
  Description of Artificial Sequence: Synthetic primer
ctattccatttgacatagtag

SEQ ID NO: 214 - DNA, 21 bp, Artificial Sequence
  Description of Artificial Sequence: Synthetic primer
ctattccatttgacatagtag

SEQ ID NO: 215 - DNA, 20 bp, Artificial Sequence
  Description of Artificial Sequence: Synthetic primer
cccacctatctcagttgata

SEQ ID NO: 216 - DNA, 19 bp, Artificial Sequence
  Description of Artificial Sequence: Synthetic primer
ggacttgattcaaatggtt

SEQ ID NO: 217 - DNA, 21 bp, Artificial Sequence
  Description of Artificial Sequence: Synthetic primer
gtccaaatataagaaactgtc

SEQ ID NO: 218 - DNA, 20 bp, Artificial Sequence
  Description of Artificial Sequence: Synthetic primer
agtttactgcttccatgtgc

SEQ ID NO: 219 - DNA, 21 bp, Artificial Sequence
  Description of Artificial Sequence: Synthetic primer
gacagtttcttatatttggac

SEQ ID NO: 220 - DNA, 20 bp, Artificial Sequence
  Description of Artificial Sequence: Synthetic primer
tcttttagccctgtacactc

SEQ ID NO: 221 - DNA, 20 bp, Artificial Sequence
  Description of Artificial Sequence: Synthetic primer
cttctgtccaagatctcctg

SEQ ID NO: 222 - DNA, 20 bp, Artificial Sequence
  Description of Artificial Sequence: Synthetic primer
tatatagcattttgttagtg

SEQ ID NO: 223 - DNA, 19 bp, Artificial Sequence
  Description of Artificial Sequence: Synthetic primer
aggtcagcagcctccagag

SEQ ID NO: 224 - DNA, 20 bp, Artificial Sequence
  Description of Artificial Sequence: Synthetic primer
tcccaccagggtcaagagaa

SEQ ID NO: 225 - DNA, 19 bp, Artificial Sequence
  Description of Artificial Sequence: Synthetic primer
tgctgacctggagacctgc

SEQ ID NO: 226 - DNA, 19 bp, Artificial Sequence
  Description of Artificial Sequence: Synthetic primer
atatagctagcaaggctgg

SEQ ID NO: 227 - DNA, 19 bp, Artificial Sequence
  Description of Artificial Sequence: Synthetic primer
tctagaattctatcagaag

SEQ ID NO: 228 - DNA, 19 bp, Artificial Sequence
  Description of Artificial Sequence: Synthetic primer
gattctgttgtagcattat

SEQ ID NO: 229 - DNA, 20 bp, Artificial Sequence
  Description of Artificial Sequence: Synthetic primer
tataacacatccccacatgc

SEQ ID NO: 230 - DNA, 20 bp, Artificial Sequence
  Description of Artificial Sequence: Synthetic primer
agtctttcttgctgggaatc

SEQ ID NO: 231 - DNA, 19 bp, Artificial Sequence
  Description of Artificial Sequence: Synthetic primer
tgatcacttggaagatttg

SEQ ID NO: 232 - DNA, 20 bp, Artificial Sequence
  Description of Artificial Sequence: Synthetic primer
aagaaattctgacaagttta

SEQ ID NO: 233 - DNA, 20 bp, Artificial Sequence
  Description of Artificial Sequence: Synthetic primer
aagaagccatccagagagac

SEQ ID NO: 234 - DNA, 20 bp, Artificial Sequence
  Description of Artificial Sequence: Synthetic primer
gtaagaattggggttaggtc

SEQ ID NO: 235 - DNA, 20 bp, Artificial Sequence
  Description of Artificial Sequence: Synthetic primer
tctctctggatggcttcttg

SEQ ID NO: 236 - DNA, 20 bp, Artificial Sequence
  Description of Artificial Sequence: Synthetic primer
ctaaccccaattcttactcc

SEQ ID NO: 237 - DNA, 20 bp, Artificial Sequence
  Description of Artificial Sequence: Synthetic primer
aagcccagtgaaatcacagc

SEQ ID NO: 238 - DNA, 20 bp, Artificial Sequence
  Description of Artificial Sequence: Synthetic primer
gaaggagtaggtggtgggat

SEQ ID NO: 239 - DNA, 20 bp, Artificial Sequence
  Description of Artificial Sequence: Synthetic primer
ctgaagctcaagcaagcaag

SEQ ID NO: 240 - DNA, 19 bp, Artificial Sequence
  Description of Artificial Sequence: Synthetic primer
gaagtggcctatcaggtct

SEQ ID NO: 241 - DNA, 20 bp, Artificial Sequence
  Description of Artificial Sequence: Synthetic primer
ggtggtaattgagatgactg

SEQ ID NO: 242 - DNA, 21 bp, Artificial Sequence
  Description of Artificial Sequence: Synthetic primer
gttttcccatatctagatgtc

SEQ ID NO: 243 - DNA, 20 bp, Artificial Sequence
  Description of Artificial Sequence: Synthetic primer
gtgaattcttcccacttctc

SEQ ID NO: 244 - DNA, 20 bp, Artificial Sequence
  Description of Artificial Sequence: Synthetic primer
ttccaaggattggaggacac

SEQ ID NO: 245 - DNA, 19 bp, Artificial Sequence
  Description of Artificial Sequence: Synthetic primer
gtgcaacaaatgcctttaa

SEQ ID NO: 246 - DNA, 19 bp, Artificial Sequence
  Description of Artificial Sequence: Synthetic primer
aaacaagcactgtagagta

SEQ ID NO: 247 - DNA, 19 bp, Artificial Sequence
  Description of Artificial Sequence: Synthetic primer
atttaatagaacaaacccc

SEQ ID NO: 248 - DNA, 18 bp, Artificial Sequence
  Description of Artificial Sequence: Synthetic primer
acttttgaatgccgcaat

SEQ ID NO: 249 - DNA, 20 bp, Artificial Sequence
  Description of Artificial Sequence: Synthetic primer
gagtagaccctaaaagggac

SEQ ID NO: 250 - DNA, 20 bp, Artificial Sequence
  Description of Artificial Sequence: Synthetic primer
tatttgtaatgtgaatttgc

SEQ ID NO: 251 - DNA, 20 bp, Artificial Sequence
  Description of Artificial Sequence: Synthetic primer
tatttgtaatgtgaatttgc

SEQ ID NO: 252 - DNA, 20 bp, Artificial Sequence
  Description of Artificial Sequence: Synthetic primer
tttagcattcccagactcag

SEQ ID NO: 253 - DNA, 20 bp, Artificial Sequence
  Description of Artificial Sequence: Synthetic primer
tggccaacatctcaacagag

SEQ ID NO: 254 - DNA, 20 bp, Artificial Sequence
  Description of Artificial Sequence: Synthetic primer
gaattagactatcccagtgc

SEQ ID NO: 255 - DNA, 19 bp, Artificial Sequence
  Description of Artificial Sequence: Synthetic primer
ggactttggcacccaagga

SEQ ID NO: 256 - DNA, 19 bp, Artificial Sequence
  Description of Artificial Sequence: Synthetic primer
cttccccctgggctttcct

SEQ ID NO: 257 - DNA, 21 bp, Artificial Sequence
  Description of Artificial Sequence: Synthetic primer
gtaaacaataaacctccattc

SEQ ID NO: 258 - DNA, 20 bp, Artificial Sequence
  Description of Artificial Sequence: Synthetic primer
ccaataaacagcctcctata

SEQ ID NO: 259 - DNA, 20 bp, Artificial Sequence
  Description of Artificial Sequence: Synthetic primer
ccttccctttagtagtagag

SEQ ID NO: 260 - DNA, 21 bp, Artificial Sequence
  Description of Artificial Sequence: Synthetic primer
cacagcccaaatgtgtaaatg

SEQ ID NO: 261 - DNA, 20 bp, Artificial Sequence
  Description of Artificial Sequence: Synthetic primer
gatgccaacgtcctttccat

SEQ ID NO: 262 - DNA, 20 bp, Artificial Sequence
  Description of Artificial Sequence: Synthetic primer
ccatttacacatttgggctg

SEQ ID NO: 263 - DNA, 20 bp, Artificial Sequence
  Description of Artificial Sequence: Synthetic primer
gatgcatgaattccagagcc

SEQ ID NO: 264 - DNA, 20 bp, Artificial Sequence
  Description of Artificial Sequence: Synthetic primer
tatattatacaatagagagg

SEQ ID NO: 265 - DNA, 18 bp, Artificial Sequence
  Description of Artificial Sequence: Synthetic primer
aggtaatccacatcaacc

SEQ ID NO: 266 - DNA, 20 bp, Artificial Sequence
  Description of Artificial Sequence: Synthetic primer
actgttatgtacattatatc

SEQ ID NO: 267 - DNA, 20 bp, Artificial Sequence
  Description of Artificial Sequence: Synthetic primer
ttttgggtgccaaacaccta

SEQ ID NO: 268 - DNA, 20 bp, Artificial Sequence
  Description of Artificial Sequence: Synthetic primer
ggacggtcaaaaggagaatg

SEQ ID NO: 269 - DNA, 20 bp, Artificial Sequence
  Description of Artificial Sequence: Synthetic primer
tggcacccaaaatttcactg

SEQ ID NO: 270 - DNA, 20 bp, Artificial Sequence
  Description of Artificial Sequence: Synthetic primer
atcaaaccaaagtgcaaagc

SEQ ID NO: 271 - DNA, 20 bp, Artificial Sequence
  Description of Artificial Sequence: Synthetic primer
tttgagaaggagaccttagc

SEQ ID NO: 272 - DNA, 20 bp, Artificial Sequence
  Description of Artificial Sequence: Synthetic primer
gaagctaaggtctccttctc

SEQ ID NO: 273 - DNA, 20 bp, Artificial Sequence
  Description of Artificial Sequence: Synthetic primer
gatgcaaagcagcctaactc

SEQ ID NO: 274 - DNA, 20 bp, Artificial Sequence
  Description of Artificial Sequence: Synthetic primer
gtgcagactgttatctagag

SEQ ID NO: 275 - DNA, 20 bp, Artificial Sequence
  Description of Artificial Sequence: Synthetic primer
acacgggtgaagttcttaac

SEQ ID NO: 276 - DNA, 20 bp, Artificial Sequence
  Description of Artificial Sequence: Synthetic primer
gaatgctttggaagaagctg

SEQ ID NO: 277 - DNA, 20 bp, Artificial Sequence
  Description of Artificial Sequence: Synthetic primer
gtggaacatcttatttcacg

SEQ ID NO: 278 - DNA, 19 bp, Artificial Sequence
  Description of Artificial Sequence: Synthetic primer
agaatttattgccatgtac

SEQ ID NO: 279 - DNA, 19 bp, Artificial Sequence
  Description of Artificial Sequence: Synthetic primer
caaggagatttaacctttc

SEQ ID NO: 280 - DNA, 20 bp, Artificial Sequence
  Description of Artificial Sequence: Synthetic primer
ctgagcaaggagatttaacc

SEQ ID NO: 281 - DNA, 20 bp, Artificial Sequence
  Description of Artificial Sequence: Synthetic primer
tgatgatctggcccttgttg

SEQ ID NO: 282 - DNA, 20 bp, Artificial Sequence
  Description of Artificial Sequence: Synthetic primer
tgacttctcctttccaccag

SEQ ID NO: 283 - DNA, 20 bp, Artificial Sequence
  Description of Artificial Sequence: Synthetic primer
atgagctggccttcaacaag

SEQ ID NO: 284 - DNA, 20 bp, Artificial Sequence
  Description of Artificial Sequence: Synthetic primer
tcatatgttgtccatccccc

SEQ ID NO: 285 - DNA, 20 bp, Artificial Sequence
  Description of Artificial Sequence: Synthetic primer
tttgctcctatctctgcaag

SEQ ID NO: 286 - DNA, 21 bp, Artificial Sequence
  Description of Artificial Sequence: Synthetic primer
gggaaagtcaatttgagtaac

SEQ ID NO: 287 - DNA, 20 bp, Artificial Sequence
  Description of Artificial Sequence: Synthetic primer
ctcttcttaatgggaagcag

SEQ ID NO: 288 - DNA, 20 bp, Artificial Sequence
  Description of Artificial Sequence: Synthetic primer
ccaaacttgggcaaagttga

SEQ ID NO: 289 - DNA, 18 bp, Artificial Sequence
  Description of Artificial Sequence: Synthetic primer
catgttagcacctcacta

SEQ ID NO: 290 - DNA, 19 bp, Artificial Sequence
  Description of Artificial Sequence: Synthetic primer
ggaattggatcaaatgatt

SEQ ID NO: 291 - DNA, 21 bp, Artificial Sequence
  Description of Artificial Sequence: Synthetic primer
ggaaaaaaatgttaatatggc

SEQ ID NO: 292 - DNA, 21 bp, Artificial Sequence
  Description of Artificial Sequence: Synthetic primer
catccaaagttttgtacatca

SEQ ID NO: 293 - DNA, 20 bp, Artificial Sequence
  Description of Artificial Sequence: Synthetic primer
catgatgtacaaaactttgg

SEQ ID NO: 294 - DNA, 19 bp, Artificial Sequence
  Description of Artificial Sequence: Synthetic primer
gttaagataggaaagaccc

SEQ ID NO: 295 - DNA, 21 bp, Artificial Sequence
  Description of Artificial Sequence: Synthetic primer
ggaataatggatcaaaaatag

SEQ ID NO: 296 - DNA, 20 bp, Artificial Sequence
  Description of Artificial Sequence: Synthetic primer
ttagtagcaagggtgtttgg

SEQ ID NO: 297 - DNA, 20 bp, Artificial Sequence
  Description of Artificial Sequence: Synthetic primer
gacatcatccattcaacacc

SEQ ID NO: 298 - DNA, 19 bp, Artificial Sequence
  Description of Artificial Sequence: Synthetic primer
tctatagactctcactcag

SEQ ID NO: 299 - DNA, 20 bp, Artificial Sequence
  Description of Artificial Sequence: Synthetic primer
tggtaacagatttgacatgg

SEQ ID NO: 300 - DNA, 20 bp, Artificial Sequence
  Description of Artificial Sequence: Synthetic primer
tcagagcttgaaaacttcag

SEQ ID NO: 301 - DNA, 19 bp, Artificial Sequence
  Description of Artificial Sequence: Synthetic primer
ttctgtgagcacactaaaa

SEQ ID NO: 302 - DNA, 20 bp, Artificial Sequence
  Description of Artificial Sequence: Synthetic primer
gtgtgctcacagaaaattag

SEQ ID NO: 303 - DNA, 20 bp, Artificial Sequence
  Description of Artificial Sequence: Synthetic primer
tcagatgcaatggttttgtg

SEQ ID NO: 304 - DNA, 19 bp, Artificial Sequence
  Description of Artificial Sequence: Synthetic primer
ccacagtataaacagtaac

SEQ ID NO: 305 - DNA, 20 bp, Artificial Sequence
  Description of Artificial Sequence: Synthetic primer
tgtaccagtcagtgattaag

SEQ ID NO: 306 - DNA, 19 bp, Artificial Sequence
  Description of Artificial Sequence: Synthetic primer
gttctacttaatcactgac

SEQ ID NO: 307 - DNA, 19 bp, Artificial Sequence
  Description of Artificial Sequence: Synthetic primer
gaactcctaagactatgat

SEQ ID NO: 308 - DNA, 20 bp, Artificial Sequence
  Description of Artificial Sequence: Synthetic primer
gaaatggtgtaaaggctgtc

SEQ ID NO: 309 - DNA, 20 bp, Artificial Sequence
  Description of Artificial Sequence: Synthetic primer
actcagacgtggtggaaaac

SEQ ID NO: 310 - DNA, 20 bp, Artificial Sequence
  Description of Artificial Sequence: Synthetic primer
tgagagctccaactccaaac

SEQ ID NO: 311 - DNA, 20 bp, Artificial Sequence
  Description of Artificial Sequence: Synthetic primer
aacgtggcattgtccccaag

SEQ ID NO: 312 - DNA, 20 bp, Artificial Sequence
  Description of Artificial Sequence: Synthetic primer
ccaggtcttgatagtctttg

SEQ ID NO: 313 - DNA, 19 bp, Artificial Sequence
  Description of Artificial Sequence: Synthetic primer
actgctttttccaggtctt

SEQ ID NO: 314 - DNA, 19 bp, Artificial Sequence
  Description of Artificial Sequence: Synthetic primer
tgtatctcccactttgacc

SEQ ID NO: 315 - DNA, 19 bp, Artificial Sequence
  Description of Artificial Sequence: Synthetic primer
ggtagagttgcaaataatt

SEQ ID NO: 316 - DNA, 20 bp, Artificial Sequence
  Description of Artificial Sequence: Synthetic primer
ccacccacatttttctcagc

SEQ ID NO: 317 - DNA, 20 bp, Artificial Sequence
  Description of Artificial Sequence: Synthetic primer
gtgcagatggaggtatctct

SEQ ID NO: 318 - DNA, 18 bp, Artificial Sequence
  Description of Artificial Sequence: Synthetic primer
gggaaaggacatcccttc

SEQ ID NO: 319 - DNA, 19 bp, Artificial Sequence
  Description of Artificial Sequence: Synthetic primer
cctgttttgagtaaacagt

SEQ ID NO: 320 - DNA, 19 bp, Artificial Sequence
  Description of Artificial Sequence: Synthetic primer
actgtttactcaaaacagg

SEQ ID NO: 321 - DNA, 20 bp, Artificial Sequence
  Description of Artificial Sequence: Synthetic primer
aatcactgggaaacaaagac

SEQ ID NO: 322 - DNA, 20 bp, Artificial Sequence
  Description of Artificial Sequence: Synthetic primer
ttcatttgtccctggtacac

SEQ ID NO: 323 - DNA, 19 bp, Artificial Sequence
  Description of Artificial Sequence: Synthetic primer
gactggaaactgttgaaag

SEQ ID NO: 324 - DNA, 19 bp, Artificial Sequence
  Description of Artificial Sequence: Synthetic primer
agaaaggcttgacaataat

SEQ ID NO: 325 - DNA, 20 bp, Artificial Sequence
  Description of Artificial Sequence: Synthetic primer
tggatttgctgttgatcacc

SEQ ID NO: 326 - DNA, 20 bp, Artificial Sequence
  Description of Artificial Sequence: Synthetic primer
tcagacactgcatattctgg

SEQ ID NO: 327 - DNA, 19 bp, Artificial Sequence
  Description of Artificial Sequence: Synthetic primer
gttttgctgacattagttg

SEQ ID NO: 328 - DNA, 18 bp, Artificial Sequence
  Description of Artificial Sequence: Synthetic primer
gctagagaaaaagccagg

SEQ ID NO: 329 - DNA, 21 bp, Artificial Sequence
  Description of Artificial Sequence: Synthetic primer
gaaaatatgtgcttttatctg

SEQ ID NO: 330 - DNA, 21 bp, Artificial Sequence
  Description of Artificial Sequence: Synthetic primer
ccttgatagtatttgccactc

SEQ ID NO: 331 - DNA, 19 bp, Artificial Sequence
  Description of Artificial Sequence: Synthetic primer
tcctgaagttcagaaacag

SEQ ID NO: 332 - DNA, 20 bp, Artificial Sequence
  Description of Artificial Sequence: Synthetic primer
agacccttattccaagggta

SEQ ID NO: 333 - DNA, 19 bp, Artificial Sequence
  Description of Artificial Sequence: Synthetic primer
gacttgagcaacacaaatg

SEQ ID NO: 334 - DNA, 20 bp, Artificial Sequence
  Description of Artificial Sequence: Synthetic primer
ccttttctgacagaaaggta

SEQ ID NO: 335 - DNA, 20 bp, Artificial Sequence
  Description of Artificial Sequence: Synthetic primer
cttagattcacactcaagcc

SEQ ID NO: 336 - DNA, 18 bp, Artificial Sequence
  Description of Artificial Sequence: Synthetic primer
gactcatcaacttctcat

SEQ ID NO: 337 - DNA, 20 bp, Artificial Sequence
  Description of Artificial Sequence: Synthetic primer
gtctgttgatttcaaaacac

SEQ ID NO: 338 - DNA, 20 bp, Artificial Sequence
  Description of Artificial Sequence: Synthetic primer
cactccagtccatgtttgag

SEQ ID NO: 339 - DNA, 21 bp, Artificial Sequence
  Description of Artificial Sequence: Synthetic primer
gagaattaaaatgaactgagg

SEQ ID NO: 340 - DNA, 19 bp, Artificial Sequence
  Description of Artificial Sequence: Synthetic primer
tacttaatccttttgcctc

SEQ ID NO: 341 - DNA, 20 bp, Artificial Sequence
  Description of Artificial Sequence: Synthetic primer
ctgcatatatcttctgcctc

SEQ ID NO: 342 - DNA, 21 bp, Artificial Sequence
  Description of Artificial Sequence: Synthetic primer
ctggttttgaattacattggc

SEQ ID NO: 343 - DNA, 19 bp, Artificial Sequence
  Description of Artificial Sequence: Synthetic primer
aagcctatttatcatacag

SEQ ID NO: 344 - DNA, 19 bp, Artificial Sequence
  Description of Artificial Sequence: Synthetic primer
gggctgcgagttcaaattc

SEQ ID NO: 345 - DNA, 20 bp, Artificial Sequence
  Description of Artificial Sequence: Synthetic primer
gaatttgaactcgcagcccc

SEQ ID NO: 346 - DNA, 20 bp, Artificial Sequence
  Description of Artificial Sequence: Synthetic primer
gaatttgaactcgcagcccc

SEQ ID NO: 347 - DNA, 19 bp, Artificial Sequence
  Description of Artificial Sequence: Synthetic primer
agaggattcagcctgctca

SEQ ID NO: 348 - DNA, 19 bp, Artificial Sequence
  Description of Artificial Sequence: Synthetic primer
gcacaggcttttaaaccca

SEQ ID NO: 349 - DNA, 21 bp, Artificial Sequence
  Description of Artificial Sequence: Synthetic primer
gcaattttgacaccttaaagc

SEQ ID NO: 350 - DNA, 20 bp, Artificial Sequence
  Description of Artificial Sequence: Synthetic primer
agtgagcaggctgaatcctc

SEQ ID NO: 351 - DNA, 19 bp, Artificial Sequence
  Description of Artificial Sequence: Synthetic primer
tgggtttaaaagcctgtgc

SEQ ID NO: 352 - DNA, 19 bp, Artificial Sequence
  Description of Artificial Sequence: Synthetic primer
tatatatgttagcacagac

SEQ ID NO: 353 - DNA, 20 bp, Artificial Sequence
  Description of Artificial Sequence: Synthetic primer
actagctgtaacctttgtgc

SEQ ID NO: 354 - DNA, 19 bp, Artificial Sequence
  Description of Artificial Sequence: Synthetic primer
acgaggtcaaatctgctcc

SEQ ID NO: 355 - DNA, 20 bp, Artificial Sequence
  Description of Artificial Sequence: Synthetic primer
gcacaaaggttacagctagt

SEQ ID NO: 356 - DNA, 20 bp, Artificial Sequence
  Description of Artificial Sequence: Synthetic primer
cttcattcagaatctttttc

SEQ ID NO: 357 - DNA, 20 bp, Artificial Sequence
  Description of Artificial Sequence: Synthetic primer
cactggggaaaagtgcacct

SEQ ID NO: 358 - DNA, 20 bp, Artificial Sequence
  Description of Artificial Sequence: Synthetic primer
tcttttggaatgggagggag

SEQ ID NO: 359 - DNA, 20 bp, Artificial Sequence
  Description of Artificial Sequence: Synthetic primer
tgccactgcaccaggagaaa

SEQ ID NO: 360 - DNA, 19 bp, Artificial Sequence
  Description of Artificial Sequence: Synthetic primer
gatgacattcttcctgtct

SEQ ID NO: 361 - DNA, 18 bp, Artificial Sequence
  Description of Artificial Sequence: Synthetic primer
gcctgagtctctctaatt

SEQ ID NO: 362 - DNA, 20 bp, Artificial Sequence
  Description of Artificial Sequence: Synthetic primer
catgtagcaaatttggtttc

SEQ ID NO: 363 - DNA, 20 bp, Artificial Sequence
  Description of Artificial Sequence: Synthetic primer
catgtagcaaatttggtttc

SEQ ID NO: 364 - DNA, 19 bp, Artificial Sequence
  Description of Artificial Sequence: Synthetic primer
ccattcaaacaaaagcccg

SEQ ID NO: 365 - DNA, 20 bp, Artificial Sequence
  Description of Artificial Sequence: Synthetic primer
agaaccgagggatgcaaaac

SEQ ID NO: 366 - DNA, 20 bp, Artificial Sequence
  Description of Artificial Sequence: Synthetic primer
ggaaccaagactacactgag

SEQ ID NO: 367 - DNA, 20 bp, Artificial Sequence
  Description of Artificial Sequence: Synthetic primer
gggctgtttcaatgagggac

SEQ ID NO: 368 - DNA, 21 bp, Artificial Sequence
  Description of Artificial Sequence: Synthetic primer
gatgtctgtgtctaaaattgg

SEQ ID NO: 369 - DNA, 20 bp, Artificial Sequence
  Description of Artificial Sequence: Synthetic primer
gtccctcattgaaacagccc

SEQ ID NO: 370 - DNA, 19 bp, Artificial Sequence
  Description of Artificial Sequence: Synthetic primer
attgtgcaattaaatgacc

SEQ ID NO: 371 - DNA, 20 bp, Artificial Sequence
  Description of Artificial Sequence: Synthetic primer
agaccttgttgtctagggtg

SEQ ID NO: 372 - DNA, 20 bp, Artificial Sequence
  Description of Artificial Sequence: Synthetic primer
cctcatcattttcagcctgg

SEQ ID NO: 373 - DNA, 20 bp, Artificial Sequence
  Description of Artificial Sequence: Synthetic primer
gctcaggtattttataaggc

SEQ ID NO: 374 - DNA, 20 bp, Artificial Sequence
  Description of Artificial Sequence: Synthetic primer
gctcaggtattttataaggc

SEQ ID NO: 375 - DNA, 20 bp, Artificial Sequence
  Description of Artificial Sequence: Synthetic primer
cagaaccgcctagaaggcaa

SEQ ID NO: 376 - DNA, 19 bp, Artificial Sequence
  Description of Artificial Sequence: Synthetic primer
tcactgaaaaccgcggaag

SEQ ID NO: 377 - DNA, 19 bp, Artificial Sequence
  Description of Artificial Sequence: Synthetic primer
gcgaaatgacctgtttacc

SEQ ID NO: 378 - DNA, 20 bp, Artificial Sequence
  Description of Artificial Sequence: Synthetic primer
agctgtccagataatttggg

SEQ ID NO: 379 - DNA, 20 bp, Artificial Sequence
  Description of Artificial Sequence: Synthetic primer
accctcagtaccactatctc

SEQ ID NO: 380 - DNA, 19 bp, Artificial Sequence
  Description of Artificial Sequence: Synthetic primer
cttgtattaaaagaagtgg

SEQ ID NO: 381 - DNA, 20 bp, Artificial Sequence
  Description of Artificial Sequence: Synthetic primer
ggagtcaagggagcatttta

SEQ ID NO: 382 - DNA, 20 bp, Artificial Sequence
  Description of Artificial Sequence: Synthetic primer
gatgtcacctctctgccttc

SEQ ID NO: 383 - DNA, 20 bp, Artificial Sequence
  Description of Artificial Sequence: Synthetic primer
gggaggtcaggacaattttt

SEQ ID NO: 384 - DNA, 18 bp, Artificial Sequence
  Description of Artificial Sequence: Synthetic primer
atgggtggacaaaacgac

SEQ ID NO: 385 - DNA, 20 bp, Artificial Sequence
  Description of Artificial Sequence: Synthetic primer
tgtgtgcaaggctctagaag

SEQ ID NO: 386 - DNA, 19 bp, Artificial Sequence
  Description of Artificial Sequence: Synthetic primer
ttttgccactttccaggtg

SEQ ID NO: 387 - DNA, 19 bp, Artificial Sequence
  Description of Artificial Sequence: Synthetic primer
ttttgccactttccaggtg

SEQ ID NO: 388 - DNA, 20 bp, Artificial Sequence
  Description of Artificial Sequence: Synthetic primer
gaagacaagtagctgacctg

SEQ ID NO: 389 - DNA, 20 bp, Artificial Sequence
  Description of Artificial Sequence: Synthetic primer
gaagacaagtagctgacctg

SEQ ID NO: 390 - DNA, 20 bp, Artificial Sequence
  Description of Artificial Sequence: Synthetic primer
tgtatgacaagccatgtggg

SEQ ID NO: 391 - DNA, 20 bp, Artificial Sequence
  Description of Artificial Sequence: Synthetic primer
cctgtcagttcaatgtgtaa

SEQ ID NO: 392 - DNA, 20 bp, Artificial Sequence
  Description of Artificial Sequence: Synthetic primer
acaggaataacctgcagcac

SEQ ID NO: 393 - DNA, 20 bp, Artificial Sequence
  Description of Artificial Sequence: Synthetic primer
attcatcgaatgtgggcgtc

SEQ ID NO: 394 - DNA, 20 bp, Artificial Sequence
  Description of Artificial Sequence: Synthetic primer
gcaggattcatcgaatgtgg

SEQ ID NO: 395 - DNA, 20 bp, Artificial Sequence
  Description of Artificial Sequence: Synthetic primer
cccacattcgatgaatcctg

SEQ ID NO: 396 - DNA, 20 bp, Artificial Sequence
  Description of Artificial Sequence: Synthetic primer
acaggagcagtgtttagagc

SEQ ID NO: 397 - DNA, 20 bp, Artificial Sequence
  Description of Artificial Sequence: Synthetic primer
ctttcagcctccagtttttg

SEQ ID NO: 398 - DNA, 19 bp, Artificial Sequence
  Description of Artificial Sequence: Synthetic primer
aacattaattctctgcctg

SEQ ID NO: 399 - DNA, 21 bp, Artificial Sequence
  Description of Artificial Sequence: Synthetic primer
ccacttgtttataagcatggg

SEQ ID NO: 400 - DNA, 19 bp, Artificial Sequence
  Description of Artificial Sequence: Synthetic primer
agactcaggaggatgaaag

SEQ ID NO: 401 - DNA, 19 bp, Artificial Sequence
  Description of Artificial Sequence: Synthetic primer
gggtcttgggttctgctgg

SEQ ID NO: 402 - DNA, 20 bp, Artificial Sequence
  Description of Artificial Sequence: Synthetic primer
tggggcctgtctggcctgag

SEQ ID NO: 403 - DNA, 19 bp, Artificial Sequence
  Description of Artificial Sequence: Synthetic primer
tgccagcagaacccaagac

SEQ ID NO: 404 - DNA, 20 bp, Artificial Sequence
  Description of Artificial Sequence: Synthetic primer
ctttctcatcttcctaattc

SEQ ID NO: 405 - DNA, 20 bp, Artificial Sequence
  Description of Artificial Sequence: Synthetic primer
atgtttcctgttctcagtgc

SEQ ID NO: 406 - DNA, 20 bp, Artificial Sequence
  Description of Artificial Sequence: Synthetic primer
gaaaggctttggagatgacc

SEQ ID NO: 407 - DNA, 20 bp, Artificial Sequence
  Description of Artificial Sequence: Synthetic primer
tgatgaaaggatttgagtgc

SEQ ID NO: 408 - DNA, 20 bp, Artificial Sequence
  Description of Artificial Sequence: Synthetic primer
ccatttccttataaaacctg

SEQ ID NO: 409 - DNA, 20 bp, Artificial Sequence
  Description of Artificial Sequence: Synthetic primer
tatcctgtgtactgtggaaa

SEQ ID NO: 410 - DNA, 19 bp, Artificial Sequence
  Description of Artificial Sequence: Synthetic primer
tgtataaatgccctcatac

SEQ ID NO: 411 - DNA, 20 bp, Artificial Sequence
  Description of Artificial Sequence: Synthetic primer
tgcagatttcttccaggaac

SEQ ID NO: 412 - DNA, 19 bp, Artificial Sequence
  Description of Artificial Sequence: Synthetic primer
ggtcatatctataataagg

SEQ ID NO: 413 - DNA, 21 bp, Artificial Sequence
  Description of Artificial Sequence: Synthetic primer
ggtccttattatagatatgac

SEQ ID NO: 414 - DNA, 20 bp, Artificial Sequence
  Description of Artificial Sequence: Synthetic primer
ggtctcatggaatacgaatg

SEQ ID NO: 415 - DNA, 19 bp, Artificial Sequence
  Description of Artificial Sequence: Synthetic primer
caatttaaaacctcattgg

SEQ ID NO: 416 - DNA, 21 bp, Artificial Sequence
  Description of Artificial Sequence: Synthetic primer
gcctacaacttctgtattgtg

SEQ ID NO: 417 - DNA, 20 bp, Artificial Sequence
  Description of Artificial Sequence: Synthetic primer
aagaccgcttttctctccac

SEQ ID NO: 418 - DNA, 20 bp, Artificial Sequence
  Description of Artificial Sequence: Synthetic primer
ggactataaattctaggagc

SEQ ID NO: 419 - DNA, 21 bp, Artificial Sequence
  Description of Artificial Sequence: Synthetic primer
gtccaagtatgaacaaaagcc

SEQ ID NO: 420 - DNA, 21 bp, Artificial Sequence
  Description of Artificial Sequence: Synthetic primer
gtgaatacttcacaatgaatc

SEQ ID NO: 421 - DNA, 20 bp, Artificial Sequence
  Description of Artificial Sequence: Synthetic primer
tcagaatctagtcctgagcg

SEQ ID NO: 422 - DNA, 20 bp, Artificial Sequence
  Description of Artificial Sequence: Synthetic primer
aacactgcactaagcagcac

SEQ ID NO: 423 - DNA, 20 bp, Artificial Sequence
  Description of Artificial Sequence: Synthetic primer
atccctgttggtagggaaag

SEQ ID NO: 424 - DNA, 20 bp, Artificial Sequence
  Description of Artificial Sequence: Synthetic primer
aaggggaacacagaactcag

SEQ ID NO: 425 - DNA, 19 bp, Artificial Sequence
  Description of Artificial Sequence: Synthetic primer
catgaacagggtatttgtc

SEQ ID NO: 426 - DNA, 19 bp, Artificial Sequence
  Description of Artificial Sequence: Synthetic primer
ccaatggaaatattgagag

SEQ ID NO: 427 - DNA, 20 bp, Artificial Sequence
  Description of Artificial Sequence: Synthetic primer
gaactgtctactgccaacat

SEQ ID NO: 428 - DNA, 21 bp, Artificial Sequence
  Description of Artificial Sequence: Synthetic primer
ggtttttctctgagatttggc

SEQ ID NO: 429 - DNA, 19 bp, Artificial Sequence
  Description of Artificial Sequence: Synthetic primer
ctgcccctgtaatgtatgg

SEQ ID NO: 430 - DNA, 20 bp, Artificial Sequence
  Description of Artificial Sequence: Synthetic primer
tgctgaacagggtgcttaac

SEQ ID NO: 431 - DNA, 20 bp, Artificial Sequence
  Description of Artificial Sequence: Synthetic primer
ctacaatccagttgcagcac

SEQ ID NO: 432 - DNA, 20 bp, Artificial Sequence
  Description of Artificial Sequence: Synthetic primer
tctgctgagcatctattatc

SEQ ID NO: 433 - DNA, 20 bp, Artificial Sequence
  Description of Artificial Sequence: Synthetic primer
cagtttgtagattaaggagg

SEQ ID NO: 434 - DNA, 19 bp, Artificial Sequence
  Description of Artificial Sequence: Synthetic primer
cagaaagaaacttaatgct

SEQ ID NO: 435 - DNA, 20 bp, Artificial Sequence
  Description of Artificial Sequence: Synthetic primer
ctcaggtaaactgtccaagc

SEQ ID NO: 436 - DNA, 20 bp, Artificial Sequence
  Description of Artificial Sequence: Synthetic primer
ccaaggttgcttataaacag

SEQ ID NO: 437 - DNA, 19 bp, Artificial Sequence
  Description of Artificial Sequence: Synthetic primer
cttttaccagttatcttcc

SEQ ID NO: 438 - DNA, 20 bp, Artificial Sequence
  Description of Artificial Sequence: Synthetic primer
gtagaacaagaaattagacc

SEQ ID NO: 439 - DNA, 19 bp, Artificial Sequence
  Description of Artificial Sequence: Synthetic primer
gaaagcaattagaacatga

SEQ ID NO: 440 - DNA, 20 bp, Artificial Sequence
  Description of Artificial Sequence: Synthetic primer
gacgtgatgatacatacagg

SEQ ID NO: 441 - DNA, 21 bp, Artificial Sequence
  Description of Artificial Sequence: Synthetic primer
gcaggatttcacaaagatgag

SEQ ID NO: 442 - DNA, 21 bp, Artificial Sequence
  Description of Artificial Sequence: Synthetic primer
atttaaaactgaatatacttg

SEQ ID NO: 443 - DNA, 20 bp, Artificial Sequence
  Description of Artificial Sequence: Synthetic primer
atttgcccaccatgaaacag

SEQ ID NO: 444 - DNA, 20 bp, Artificial Sequence
  Description of Artificial Sequence: Synthetic primer
actaaaaagctggagggagg

SEQ ID NO: 445 - DNA, 21 bp, Artificial Sequence
  Description of Artificial Sequence: Synthetic primer
ccaggttcaatacattaggac

SEQ ID NO: 446 - DNA, 20 bp, Artificial Sequence
  Description of Artificial Sequence: Synthetic primer
agacaaggtacacgaaaggg

SEQ ID NO: 447 - DNA, 19 bp, Artificial Sequence
  Description of Artificial Sequence: Synthetic primer
tgtgaaaattagtctcctc

SEQ ID NO: 448 - DNA, 19 bp, Artificial Sequence
  Description of Artificial Sequence: Synthetic primer
gccaaactttaatccattt

SEQ ID NO: 449 - DNA, 21 bp, Artificial Sequence
  Description of Artificial Sequence: Synthetic primer
ctaccctttaagaatgagttc

SEQ ID NO: 450 - DNA, 20 bp, Artificial Sequence
  Description of Artificial Sequence: Synthetic primer
ctgcagttgttagaggaacc

SEQ ID NO: 451 - DNA, 20 bp, Artificial Sequence
  Description of Artificial Sequence: Synthetic primer
agtggaagagtgacagattc

SEQ ID NO: 452 - DNA, 20 bp, Artificial Sequence
  Description of Artificial Sequence: Synthetic primer
ctgcagttgttagaggaacc

SEQ ID NO: 453 - DNA, 20 bp, Artificial Sequence
  Description of Artificial Sequence: Synthetic primer
tttggaggccttgattcttc

SEQ ID NO: 454 - DNA, 20 bp, Artificial Sequence
  Description of Artificial Sequence: Synthetic primer
tatgcttcacttcagaagac

SEQ ID NO: 455 - DNA, 20 bp, Artificial Sequence
  Description of Artificial Sequence: Synthetic primer
tgttatgtgaggtacctaag

SEQ ID NO: 456 - DNA, 20 bp, Artificial Sequence
  Description of Artificial Sequence: Synthetic primer
agactcaaaagcacagacag

SEQ ID NO: 457 - DNA, 20 bp, Artificial Sequence
  Description of Artificial Sequence: Synthetic primer
gatttcctgagattagtctt

SEQ ID NO: 458 - DNA, 19 bp, Artificial Sequence
  Description of Artificial Sequence: Synthetic primer
atcccaaagacatttttgc

SEQ ID NO: 459 - DNA, 21 bp, Artificial Sequence
  Description of Artificial Sequence: Synthetic primer
ccattgtcaattcttttccag

SEQ ID NO: 460 - DNA, 20 bp, Artificial Sequence
  Description of Artificial Sequence: Synthetic primer
acctatctgacaatgactgg

SEQ ID NO: 461 - DNA, 20 bp, Artificial Sequence
  Description of Artificial Sequence: Synthetic primer
ctctcaaaagagaatagcag

SEQ ID NO: 462 - DNA, 19 bp, Artificial Sequence
  Description of Artificial Sequence: Synthetic primer
aatatctagtaactactgg

SEQ ID NO: 463 - DNA, 21 bp, Artificial Sequence
  Description of Artificial Sequence: Synthetic primer
gttgaatggttatcttttcac

SEQ ID NO: 464 - DNA, 20 bp, Artificial Sequence
  Description of Artificial Sequence: Synthetic primer
cattacatagaataaagaac

SEQ ID NO: 465 - DNA, 20 bp, Artificial Sequence
  Description of Artificial Sequence: Synthetic primer
gaccactattaattgttcct

SEQ ID NO: 466 - DNA, 21 bp, Artificial Sequence
  Description of Artificial Sequence: Synthetic primer
gataggaacaattaatagtgg

SEQ ID NO: 467 - DNA, 20 bp, Artificial Sequence
  Description of Artificial Sequence: Synthetic primer
aatttaactaaggtaggttt

SEQ ID NO: 468 - DNA, 20 bp, Artificial Sequence
  Description of Artificial Sequence: Synthetic primer
ggccagagttcatcacaatc

SEQ ID NO: 469 - DNA, 20 bp, Artificial Sequence
  Description of Artificial Sequence: Synthetic primer
ctgcaagcagtattaccagg

SEQ ID NO: 470 - DNA, 20 bp, Artificial Sequence
  Description of Artificial Sequence: Synthetic primer
aaggcacagcattgtcattg

SEQ ID NO: 471 - DNA, 19 bp, Artificial Sequence
  Description of Artificial Sequence: Synthetic primer
tgaccctcaggtgctgcat

SEQ ID NO: 472 - DNA, 20 bp, Artificial Sequence
  Description of Artificial Sequence: Synthetic primer
aatgctgtgccttccactcc

SEQ ID NO: 473 - DNA, 20 bp, Artificial Sequence
  Description of Artificial Sequence: Synthetic primer
cctacctcacttggcttctg

SEQ ID NO: 474 - DNA, 21 bp, Artificial Sequence
  Description of Artificial Sequence: Synthetic primer
aaacataagtttaaagataag

SEQ ID NO: 475 - DNA, 20 bp, Artificial Sequence
  Description of Artificial Sequence: Synthetic primer
agctcttcttgctttccctg

SEQ ID NO: 476 - DNA, 19 bp, Artificial Sequence
  Description of Artificial Sequence: Synthetic primer
gtgactttttatggagagg

SEQ ID NO: 477 - DNA, 20 bp, Artificial Sequence
  Description of Artificial Sequence: Synthetic primer
gagtacttgtcctccaagat

SEQ ID NO: 478 - DNA, 19 bp, Artificial Sequence
  Description of Artificial Sequence: Synthetic primer
cctctccataaaaagtcac

SEQ ID NO: 479 - DNA, 20 bp, Artificial Sequence
  Description of Artificial Sequence: Synthetic primer
aaagatcttggaggacaagt

SEQ ID NO: 480 - DNA, 20 bp, Artificial Sequence
  Description of Artificial Sequence: Synthetic primer
aggacaagtactcttccttc

SEQ ID NO: 481 - DNA, 20 bp, Artificial Sequence
  Description of Artificial Sequence: Synthetic primer
ttgggcataattcttgctgg

SEQ ID NO: 482 - DNA, 20 bp, Artificial Sequence
  Description of Artificial Sequence: Synthetic primer
atcctggtcagcataattcc

SEQ ID NO: 483 - DNA, 20 bp, Artificial Sequence
  Description of Artificial Sequence: Synthetic primer
ttgagtagatcctggtcagc

SEQ ID NO: 484 - DNA, 20 bp, Artificial Sequence
  Description of Artificial Sequence: Synthetic primer
attcaaagctgtgtattggg

SEQ ID NO: 485 - DNA, 20 bp, Artificial Sequence
  Description of Artificial Sequence: Synthetic primer
ttctggcacactttgcactc

SEQ ID NO: 486 - DNA, 20 bp, Artificial Sequence
  Description of Artificial Sequence: Synthetic primer
gcatcatgaacctttcagac

SEQ ID NO: 487 - DNA, 20 bp, Artificial Sequence
  Description of Artificial Sequence: Synthetic primer
gttacactgcaaagcatttc

SEQ ID NO: 488 - DNA, 20 bp, Artificial Sequence
  Description of Artificial Sequence: Synthetic primer
gttacactgcaaagcatttc

SEQ ID NO: 489 - DNA, 20 bp, Artificial Sequence
  Description of Artificial Sequence: Synthetic primer
gctggatacctaattaatgc

SEQ ID NO: 490 - DNA, 20 bp, Artificial Sequence
  Description of Artificial Sequence: Synthetic primer
tatgcataagtttaactgta

SEQ ID NO: 491 - DNA, 20 bp, Artificial Sequence
  Description of Artificial Sequence: Synthetic primer
gtttcaagatgcttgactgg

SEQ ID NO: 492 - DNA, 20 bp, Artificial Sequence
  Description of Artificial Sequence: Synthetic primer
gtttcttgtaagcatatggg

SEQ ID NO: 493 - DNA, 20 bp, Artificial Sequence
  Description of Artificial Sequence: Synthetic primer
catcccagttatgtcctttc

SEQ ID NO: 494 - DNA, 19 bp, Artificial Sequence
  Description of Artificial Sequence: Synthetic primer
tcagtaaggaattggtgga

SEQ ID NO: 495 - DNA, 20 bp, Artificial Sequence
  Description of Artificial Sequence: Synthetic primer
gtcattgtcacaaaaatcac

SEQ ID NO: 496 - DNA, 19 bp, Artificial Sequence
  Description of Artificial Sequence: Synthetic primer
ccaatgatccatagtaatc

SEQ ID NO: 497 - DNA, 19 bp, Artificial Sequence
  Description of Artificial Sequence: Synthetic primer
ctggtgcaaaaacacttaa

SEQ ID NO: 498 - DNA, 20 bp, Artificial Sequence
  Description of Artificial Sequence: Synthetic primer
aatgaggttggttccaaccc

SEQ ID NO: 499 - DNA, 20 bp, Artificial Sequence
  Description of Artificial Sequence: Synthetic primer
gaaagtgatgagtatttgag

SEQ ID NO: 500 - DNA, 20 bp, Artificial Sequence
  Description of Artificial Sequence: Synthetic primer
gctgttcaccaatgctttta

SEQ ID NO: 501 - DNA, 19 bp, Artificial Sequence
  Description of Artificial Sequence: Synthetic primer
ccagacaacacataagaat

SEQ ID NO: 502 - DNA, 21 bp, Artificial Sequence
  Description of Artificial Sequence: Synthetic primer
gaaagcaatgctgatttggtc

SEQ ID NO: 503 - DNA, 19 bp, Artificial Sequence
  Description of Artificial Sequence: Synthetic primer
tctagcctctttggatgac

SEQ ID NO: 504 - DNA, 19 bp, Artificial Sequence
  Description of Artificial Sequence: Synthetic primer
accttcagttacatgttag

SEQ ID NO: 505 - DNA, 19 bp, Artificial Sequence
  Description of Artificial Sequence: Synthetic primer
atacatgatcaacaacagc

SEQ ID NO: 506 - DNA, 19 bp, Artificial Sequence
  Description of Artificial Sequence: Synthetic primer
ctaacatgtaactgaaggt

SEQ ID NO: 507 - DNA, 20 bp, Artificial Sequence
  Description of Artificial Sequence: Synthetic primer
tcaatctggaagagaagaac

SEQ ID NO: 508 - DNA, 20 bp, Artificial Sequence
  Description of Artificial Sequence: Synthetic primer
tgcacttgctgaagtaactc

SEQ ID NO: 509 - DNA, 21 bp, Artificial Sequence
  Description of Artificial Sequence: Synthetic primer
gtttgccttacctataatttg

SEQ ID NO: 510 - DNA, 19 bp, Artificial Sequence
  Description of Artificial Sequence: Synthetic primer
aaagggtaatgatcatgta

SEQ ID NO: 511 - DNA, 20 bp, Artificial Sequence
  Description of Artificial Sequence: Synthetic primer
gagattagtttaagcctggg

SEQ ID NO: 512 - DNA, 21 bp, Artificial Sequence
  Description of Artificial Sequence: Synthetic primer
cttttttatgtcacctcttag

SEQ ID NO: 513 - DNA, 21 bp, Artificial Sequence
  Description of Artificial Sequence: Synthetic primer
cttttttatgtcacctcttag

SEQ ID NO: 514 - DNA, 21 bp, Artificial Sequence
  Description of Artificial Sequence: Synthetic primer
gagatctctcctttttcttac

SEQ ID NO: 515 - DNA, 21 bp, Artificial Sequence
  Description of Artificial Sequence: Synthetic primer
gaattataaaatactatttgg

SEQ ID NO: 516 - DNA, 20 bp, Artificial Sequence
  Description of Artificial Sequence: Synthetic primer
actggatggctttttagtgt

SEQ ID NO: 517 - DNA, 20 bp, Artificial Sequence
  Description of Artificial Sequence: Synthetic primer
acactcagggaatttacaac

SEQ ID NO: 518 - DNA, 21 bp, Artificial Sequence
  Description of Artificial Sequence: Synthetic primer
tacaaaataaactcatcaatt

SEQ ID NO: 519 - DNA, 20 bp, Artificial Sequence
  Description of Artificial Sequence: Synthetic primer
ttcccatttcaacctgcctc

SEQ ID NO: 520 - DNA, 20 bp, Artificial Sequence
  Description of Artificial Sequence: Synthetic primer
gatcatgtaatggcataagc

SEQ ID NO: 521 - DNA, 20 bp, Artificial Sequence
  Description of Artificial Sequence: Synthetic primer
ctctgtgggaaatgactatc

SEQ ID NO: 522 - DNA, 20 bp, Artificial Sequence
  Description of Artificial Sequence: Synthetic primer
caaagatagtatggtgcctc

SEQ ID NO: 523 - DNA, 19 bp, Artificial Sequence
  Description of Artificial Sequence: Synthetic primer
gccattacatgatcagttt

SEQ ID NO: 524 - DNA, 20 bp, Artificial Sequence
  Description of Artificial Sequence: Synthetic primer
gtggctcataaacagcttag

SEQ ID NO: 525 - DNA, 20 bp, Artificial Sequence
  Description of Artificial Sequence: Synthetic primer
tgttttcaatgttttatgtg

SEQ ID NO: 526 - DNA, 20 bp, Artificial Sequence
  Description of Artificial Sequence: Synthetic primer
cctgttttgtaaaagctggt

SEQ ID NO: 527 - DNA, 20 bp, Artificial Sequence
  Description of Artificial Sequence: Synthetic primer
accagcttttacaaaacagg

SEQ ID NO: 528 - DNA, 20 bp, Artificial Sequence
  Description of Artificial Sequence: Synthetic primer
taggaagatacattccagac

SEQ ID NO: 529 - DNA, 19 bp, Artificial Sequence
  Description of Artificial Sequence: Synthetic primer
ttgaaaattcctcagactc

SEQ ID NO: 530 - DNA, 20 bp, Artificial Sequence
  Description of Artificial Sequence: Synthetic primer
tggttttaggctacgtgctc

SEQ ID NO: 531 - DNA, 20 bp, Artificial Sequence
  Description of Artificial Sequence: Synthetic primer
tgctgttaatgagatccgag

SEQ ID NO: 532 - DNA, 20 bp, Artificial Sequence
  Description of Artificial Sequence: Synthetic primer
gacctgaagtaatgaacagt

SEQ ID NO: 533 - DNA, 19 bp, Artificial Sequence
  Description of Artificial Sequence: Synthetic primer
ggcatactattaaacacac

SEQ ID NO: 534 - DNA, 20 bp, Artificial Sequence
  Description of Artificial Sequence: Synthetic primer
catagtgttaagacattgtg

SEQ ID NO: 535 - DNA, 20 bp, Artificial Sequence
  Description of Artificial Sequence: Synthetic primer
gctttggtctctgccaaatc

SEQ ID NO: 536 - DNA, 20 bp, Artificial Sequence
  Description of Artificial Sequence: Synthetic primer
actcagaaagcttgcctctc

SEQ ID NO: 537 - DNA, 20 bp, Artificial Sequence
  Description of Artificial Sequence: Synthetic primer
atgaggaggcagaatctcag

SEQ ID NO: 538 - DNA, 20 bp, Artificial Sequence
  Description of Artificial Sequence: Synthetic primer
aagtgccctctacctattgg

SEQ ID NO: 539 - DNA, 21 bp, Artificial Sequence
  Description of Artificial Sequence: Synthetic primer
tatatataaaattcactttgc

SEQ ID NO: 540 - DNA, 20 bp, Artificial Sequence
  Description of Artificial Sequence: Synthetic primer
cgagtttctccaaacagatg

SEQ ID NO: 541 - DNA, 20 bp, Artificial Sequence
  Description of Artificial Sequence: Synthetic primer
gcaggtactggaaatctgct

SEQ ID NO: 542 - DNA, 20 bp, Artificial Sequence
  Description of Artificial Sequence: Synthetic primer
aatcacagaagggctatcag

SEQ ID NO: 543 - DNA, 20 bp, Artificial Sequence
  Description of Artificial Sequence: Synthetic primer
ctttggtaccaattctagat

SEQ ID NO: 544 - DNA, 20 bp, Artificial Sequence
  Description of Artificial Sequence: Synthetic primer
acaagctctatcttccttac

SEQ ID NO: 545 - DNA, 20 bp, Artificial Sequence
  Description of Artificial Sequence: Synthetic primer
ttctacagaccaggctgttg

SEQ ID NO: 546 - DNA, 21 bp, Artificial Sequence
  Description of Artificial Sequence: Synthetic primer
ctgaaacttttttcaatgccc

SEQ ID NO: 547 - DNA, 20 bp, Artificial Sequence
  Description of Artificial Sequence: Synthetic primer
ttcagccatgttcaaaaggg

SEQ ID NO: 548 - DNA, 20 bp, Artificial Sequence
  Description of Artificial Sequence: Synthetic primer
cttttggagtctctctgcta

SEQ ID NO: 549 - DNA, 19 bp, Artificial Sequence
  Description of Artificial Sequence: Synthetic primer
aacagaacaaaacttgatg

SEQ ID NO: 550 - DNA, 20 bp, Artificial Sequence
  Description of Artificial Sequence: Synthetic primer
ctgttctacaatagaggctt

SEQ ID NO: 551 - DNA, 20 bp, Artificial Sequence
  Description of Artificial Sequence: Synthetic primer
aaagaactggcagaatgtgg

SEQ ID NO: 552 - DNA, 20 bp, Artificial Sequence
  Description of Artificial Sequence: Synthetic primer
ccatatggacttttgagcag

SEQ ID NO: 553 - DNA, 21 bp, Artificial Sequence
  Description of Artificial Sequence: Synthetic primer
ctcaaaagtccatatggttgc

SEQ ID NO: 554 - DNA, 20 bp, Artificial Sequence
  Description of Artificial Sequence: Synthetic primer
tcaaaagccattcaggcttc

SEQ ID NO: 555 - DNA, 20 bp, Artificial Sequence
  Description of Artificial Sequence: Synthetic primer
catggctagatctggtttcc

SEQ ID NO: 556 - DNA, 20 bp, Artificial Sequence
  Description of Artificial Sequence: Synthetic primer
aaccagatctagccatgttc

SEQ ID NO: 557 - DNA, 20 bp, Artificial Sequence
  Description of Artificial Sequence: Synthetic primer
gttcagagaagtagaaaggc

SEQ ID NO: 558 - DNA, 20 bp, Artificial Sequence
  Description of Artificial Sequence: Synthetic primer
tgaggtgactctgtgtttgg

SEQ ID NO: 559 - DNA, 20 bp, Artificial Sequence
  Description of Artificial Sequence: Synthetic primer
gcctttctacttctctgaac

SEQ ID NO: 560 - DNA, 20 bp, Artificial Sequence
  Description of Artificial Sequence: Synthetic primer
aacccaaacacagagtcacc

SEQ ID NO: 561 - DNA, 20 bp, Artificial Sequence
  Description of Artificial Sequence: Synthetic primer
gaatctatcataatctcagc

SEQ ID NO: 562 - DNA, 19 bp, Artificial Sequence
  Description of Artificial Sequence: Synthetic primer
ctcaattttactggttctc

SEQ ID NO: 563 - DNA, 20 bp, Artificial Sequence
  Description of Artificial Sequence: Synthetic primer
tacaggaatgtaggaagatg

SEQ ID NO: 564 - DNA, 21 bp, Artificial Sequence
  Description of Artificial Sequence: Synthetic primer
gcagtcttacaaaacctaagc

SEQ ID NO: 565 - DNA, 21 bp, Artificial Sequence
  Description of Artificial Sequence: Synthetic primer
ctgtgggaaaagcatttttag

SEQ ID NO: 566 - DNA, 20 bp, Artificial Sequence
  Description of Artificial Sequence: Synthetic primer
cttcctacattcctgtaatc

SEQ ID NO: 567 - DNA, 20 bp, Artificial Sequence
  Description of Artificial Sequence: Synthetic primer
tataatccctcctttcccag

SEQ ID NO: 568 - DNA, 20 bp, Artificial Sequence
  Description of Artificial Sequence: Synthetic primer
tataatccctcctttcccag

SEQ ID NO: 569 - DNA, 20 bp, Artificial Sequence
  Description of Artificial Sequence: Synthetic primer
ctaagtgtatgctctgtgcc

SEQ ID NO: 570 - DNA, 20 bp, Artificial Sequence
  Description of Artificial Sequence: Synthetic primer
tcggatctccttctagagtc

SEQ ID NO: 571 - DNA, 20 bp, Artificial Sequence
  Description of Artificial Sequence: Synthetic primer
aaggagatccgagaggcaga

SEQ ID NO: 572 - DNA, 20 bp, Artificial Sequence
  Description of Artificial Sequence: Synthetic primer
gactcatgatgccccttttc

SEQ ID NO: 573 - DNA, 19 bp, Artificial Sequence
  Description of Artificial Sequence: Synthetic primer
gcactgatccaccactagc

SEQ ID NO: 574 - DNA, 19 bp, Artificial Sequence
  Description of Artificial Sequence: Synthetic primer
aagtaacactattctgtgg

SEQ ID NO: 575 - DNA, 20 bp, Artificial Sequence
  Description of Artificial Sequence: Synthetic primer
gatttcagttatatatgtag

SEQ ID NO: 576 - DNA, 19 bp, Artificial Sequence
  Description of Artificial Sequence: Synthetic primer
ttggcatactagtatatgt

SEQ ID NO: 577 - DNA, 20 bp, Artificial Sequence
  Description of Artificial Sequence: Synthetic primer
tcagttttactccccagagg

SEQ ID NO: 578 - DNA, 19 bp, Artificial Sequence
  Description of Artificial Sequence: Synthetic primer
tctaatcaggagattttgg

SEQ ID NO: 579 - DNA, 20 bp, Artificial Sequence
  Description of Artificial Sequence: Synthetic primer
ggatttaaatatggaccagc

SEQ ID NO: 580 - DNA, 21 bp, Artificial Sequence
  Description of Artificial Sequence: Synthetic primer
cactgttgtatacttcgtagc

SEQ ID NO: 581 - DNA, 21 bp, Artificial Sequence
  Description of Artificial Sequence: Synthetic primer
gtatgtatatgataaagctag

SEQ ID NO: 582 - DNA, 18 bp, Artificial Sequence
  Description of Artificial Sequence: Synthetic primer
cactaaggcctttccaat

SEQ ID NO: 583 - DNA, 18 bp, Artificial Sequence
  Description of Artificial Sequence: Synthetic primer
attggaaaggccttagtg

SEQ ID NO: 584 - DNA, 19 bp, Artificial Sequence
  Description of Artificial Sequence: Synthetic primer
tcattttagtttggagaac

SEQ ID NO: 585 - DNA, 20 bp, Artificial Sequence
  Description of Artificial Sequence: Synthetic primer
tagttattagtaaacaactc

SEQ ID NO: 586 - DNA, 20 bp, Artificial Sequence
  Description of Artificial Sequence: Synthetic primer
gggagggcattcacacaaaa

SEQ ID NO: 587 - DNA, 20 bp, Artificial Sequence
  Description of Artificial Sequence: Synthetic primer
gcagagtccaatgcataatt

SEQ ID NO: 588 - DNA, 20 bp, Artificial Sequence
  Description of Artificial Sequence: Synthetic primer
cctggcattcaggttaaaat

SEQ ID NO: 589 - DNA, 21 bp, Artificial Sequence
  Description of Artificial Sequence: Synthetic primer
ctgatctcagagtttaaaacc

SEQ ID NO: 590 - DNA, 21 bp, Artificial Sequence
  Description of Artificial Sequence: Synthetic primer
gcataactgttctcaaccttg

SEQ ID NO: 591 - DNA, 19 bp, Artificial Sequence
  Description of Artificial Sequence: Synthetic primer
gagagacgctgcacgtgga

SEQ ID NO: 592 - DNA, 20 bp, Artificial Sequence
  Description of Artificial Sequence: Synthetic primer
gttccagatgactccagaga

SEQ ID NO: 593 - DNA, 20 bp, Artificial Sequence
  Description of Artificial Sequence: Synthetic primer
gtgcaatctgctacacctac

SEQ ID NO: 594 - DNA, 20 bp, Artificial Sequence
  Description of Artificial Sequence: Synthetic primer
ctgttctgttcccaggtgag

SEQ ID NO: 595 - DNA, 20 bp, Artificial Sequence
  Description of Artificial Sequence: Synthetic primer
tgtgtacaagtttgtctgtg

SEQ ID NO: 596 - DNA, 19 bp, Artificial Sequence
  Description of Artificial Sequence: Synthetic primer
gttaaaggatctccacaat

SEQ ID NO: 597 - DNA, 20 bp, Artificial Sequence
  Description of Artificial Sequence: Synthetic primer
ctggctatttttggtagggc

SEQ ID NO: 598 - DNA, 20 bp, Artificial Sequence
  Description of Artificial Sequence: Synthetic primer
tctctaggaaacagtctggc

SEQ ID NO: 599 - DNA, 20 bp, Artificial Sequence
  Description of Artificial Sequence: Synthetic primer
cctctctgctgctttagatg

SEQ ID NO: 600 - DNA, 20 bp, Artificial Sequence
  Description of Artificial Sequence: Synthetic primer
aaacctggatctcctccttc

SEQ ID NO: 601 - DNA, 19 bp, Artificial Sequence
  Description of Artificial Sequence: Synthetic primer
aactgaaaaggtatacctc

SEQ ID NO: 602 - DNA, 20 bp, Artificial Sequence
  Description of Artificial Sequence: Synthetic primer
gtcttaaagagaagactgcc

SEQ ID NO: 603 - DNA, 20 bp, Artificial Sequence
  Description of Artificial Sequence: Synthetic primer
agtactttacctttcaaggc

SEQ ID NO: 604 - DNA, 20 bp, Artificial Sequence
  Description of Artificial Sequence: Synthetic primer
tgatcaactgaatatgtata

SEQ ID NO: 605 - DNA, 20 bp, Artificial Sequence
  Description of Artificial Sequence: Synthetic primer
aatagctatctgccagtctc

SEQ ID NO: 606 - DNA, 20 bp, Artificial Sequence
  Description of Artificial Sequence: Synthetic primer
taacaatgccatcttgcctg

SEQ ID NO: 607 - DNA, 20 bp, Artificial Sequence
  Description of Artificial Sequence: Synthetic primer
gaatgaatcctaagaggcag

SEQ ID NO: 608 - DNA, 20 bp, Artificial Sequence
  Description of Artificial Sequence: Synthetic primer
cctttcttgctgtctatttg

SEQ ID NO: 609 - DNA, 20 bp, Artificial Sequence
  Description of Artificial Sequence: Synthetic primer
ctcataatttgaacagagac

SEQ ID NO: 610 - DNA, 19 bp, Artificial Sequence
  Description of Artificial Sequence: Synthetic primer
ccatcatttatgcatgaca

SEQ ID NO: 611 - DNA, 20 bp, Artificial Sequence
  Description of Artificial Sequence: Synthetic primer
gaagatcaaccacacatagc

SEQ ID NO: 612 - DNA, 20 bp, Artificial Sequence
  Description of Artificial Sequence: Synthetic primer
tatttttgtatcagtctatg

SEQ ID NO: 613 - DNA, 21 bp, Artificial Sequence
  Description of Artificial Sequence: Synthetic primer
gtttagttgttttctcccctg

SEQ ID NO: 614 - DNA, 19 bp, Artificial Sequence
  Description of Artificial Sequence: Synthetic primer
cccactattcagacattag

SEQ ID NO: 615 - DNA, 20 bp, Artificial Sequence
  Description of Artificial Sequence: Synthetic primer
ctcagtgaatgcgtgagatt

SEQ ID NO: 616 - DNA, 21 bp, Artificial Sequence
  Description of Artificial Sequence: Synthetic primer
ggcaaacataatttggatggg

SEQ ID NO: 617 - DNA, 21 bp, Artificial Sequence
  Description of Artificial Sequence: Synthetic primer
gttctctaagttaccaaaatc

SEQ ID NO: 618 - DNA, 20 bp, Artificial Sequence
  Description of Artificial Sequence: Synthetic primer
gcttctaccaagtttatttg

SEQ ID NO: 619 - DNA, 19 bp, Artificial Sequence
  Description of Artificial Sequence: Synthetic primer
gaattgctaacatttccat

SEQ ID NO: 620 - DNA, 20 bp, Artificial Sequence
  Description of Artificial Sequence: Synthetic primer
gtttgaaattctgaatttgc

SEQ ID NO: 621 - DNA, 20 bp, Artificial Sequence
  Description of Artificial Sequence: Synthetic primer
ttcatctgcataatttaatc

SEQ ID NO: 622 - DNA, 19 bp, Artificial Sequence
  Description of Artificial Sequence: Synthetic primer
tgttttatacagctctcag

SEQ ID NO: 623 - DNA, 20 bp, Artificial Sequence
  Description of Artificial Sequence: Synthetic primer
aaaggcactgtttctagaac

SEQ ID NO: 624 - DNA, 20 bp, Artificial Sequence
  Description of Artificial Sequence: Synthetic primer
ttaccctgcacagctttgag

SEQ ID NO: 625 - DNA, 19 bp, Artificial Sequence
  Description of Artificial Sequence: Synthetic primer
gagggacagacagctcttc

SEQ ID NO: 626 - DNA, 20 bp, Artificial Sequence
  Description of Artificial Sequence: Synthetic primer
acttcacagaaaccgttccc

SEQ ID NO: 627 - DNA, 20 bp, Artificial Sequence
  Description of Artificial Sequence: Synthetic primer
cacatcttcctggattggag

SEQ ID NO: 628 - DNA, 19 bp, Artificial Sequence
  Description of Artificial Sequence: Synthetic primer
atactcacagtcttagatg

SEQ ID NO: 629 - DNA, 20 bp, Artificial Sequence
  Description of Artificial Sequence: Synthetic primer
ttagctccatgacagaccag

SEQ ID NO: 630 - DNA, 20 bp, Artificial Sequence
  Description of Artificial Sequence: Synthetic primer
gctgaaggaataacacttac

SEQ ID NO: 631 - DNA, 20 bp, Artificial Sequence
  Description of Artificial Sequence: Synthetic primer
gctacaaaaacctactttgg

SEQ ID NO: 632 - DNA, 20 bp, Artificial Sequence
  Description of Artificial Sequence: Synthetic primer
ctgctttaatggcaatcaag

SEQ ID NO: 633 - DNA, 20 bp, Artificial Sequence
  Description of Artificial Sequence: Synthetic primer
tcttcataactactacaata

SEQ ID NO: 634 - DNA, 20 bp, Artificial Sequence
  Description of Artificial Sequence: Synthetic primer
gggttggatttgcatcctaa

SEQ ID NO: 635 - DNA, 19 bp, Artificial Sequence
  Description of Artificial Sequence: Synthetic primer
atggtggacatttgagcag

SEQ ID NO: 636 - DNA, 20 bp, Artificial Sequence
  Description of Artificial Sequence: Synthetic primer
gtgtgtataatgtttgcctc

SEQ ID NO: 637 - DNA, 21 bp, Artificial Sequence
  Description of Artificial Sequence: Synthetic primer
ccataagttttaggctgtacc

SEQ ID NO: 638 - DNA, 20 bp, Artificial Sequence
  Description of Artificial Sequence: Synthetic primer
gaggcaaacattatacacac

SEQ ID NO: 639 - DNA, 20 bp, Artificial Sequence
  Description of Artificial Sequence: Synthetic primer
ctgtgtcaaatatgtgactg

SEQ ID NO: 640 - DNA, 20 bp, Artificial Sequence
  Description of Artificial Sequence: Synthetic primer
ccatggtcagtaatagtttg

SEQ ID NO: 641 - DNA, 20 bp, Artificial Sequence
  Description of Artificial Sequence: Synthetic primer
aattgtggttattgtatttc

SEQ ID NO: 642 - DNA, 18 bp, Artificial Sequence
  Description of Artificial Sequence: Synthetic primer
tgcagacagacatggtcc

SEQ ID NO: 643 - DNA, 19 bp, Artificial Sequence
  Description of Artificial Sequence: Synthetic primer
ctttcaagaagttcatact

SEQ ID NO: 644 - DNA, 19 bp, Artificial Sequence
  Description of Artificial Sequence: Synthetic primer
tcagaccatttttgaacat

SEQ ID NO: 645 - DNA, 20 bp, Artificial Sequence
  Description of Artificial Sequence: Synthetic primer
gggaaatggccattcaatac

SEQ ID NO: 646 - DNA, 20 bp, Artificial Sequence
  Description of Artificial Sequence: Synthetic primer
gtattgaatggccatttccc

SEQ ID NO: 647 - DNA, 20 bp, Artificial Sequence
  Description of Artificial Sequence: Synthetic primer
ttaaaacagtgtacaagtaa

SEQ ID NO: 648 - DNA, 18 bp, Artificial Sequence
  Description of Artificial Sequence: Synthetic primer
aggccagggagcccacag

SEQ ID NO: 649 - DNA, 20 bp, Artificial Sequence
  Description of Artificial Sequence: Synthetic primer
agacattgatgccagctcag

SEQ ID NO: 650 - DNA, 20 bp, Artificial Sequence
  Description of Artificial Sequence: Synthetic primer
acactctgaaggaactcagg

SEQ ID NO: 651 - DNA, 20 bp, Artificial Sequence
  Description of Artificial Sequence: Synthetic primer
ggcacaggatggtggaactt

SEQ ID NO: 652 - DNA, 19 bp, Artificial Sequence
  Description of Artificial Sequence: Synthetic primer
gggctgagcatcccatcct

SEQ ID NO: 653 - DNA, 18 bp, Artificial Sequence
  Description of Artificial Sequence: Synthetic primer
tgaaagaacatggtgttg

SEQ ID NO: 654 - DNA, 19 bp, Artificial Sequence
  Description of Artificial Sequence: Synthetic primer
gggctgagcatcccatcct

SEQ ID NO: 655 - DNA, 20 bp, Artificial Sequence
  Description of Artificial Sequence: Synthetic primer
gactccagctcctggtacaa

SEQ ID NO: 656 - DNA, 19 bp, Artificial Sequence
  Description of Artificial Sequence: Synthetic primer
ggccagtttattagaaaga

SEQ ID NO: 657 - DNA, 18 bp, Artificial Sequence
  Description of Artificial Sequence: Synthetic primer
gaagtcgcttgccaaggg

SEQ ID NO: 658 - DNA, 20 bp, Artificial Sequence
  Description of Artificial Sequence: Synthetic primer
ggaattggttataacacccg

SEQ ID NO: 659 - DNA, 19 bp, Artificial Sequence
  Description of Artificial Sequence: Synthetic primer
gaaagggtttccaggtcaa

SEQ ID NO: 660 - DNA, 18 bp, Artificial Sequence
  Description of Artificial Sequence: Synthetic primer
ggctctttagttgagtgc

SEQ ID NO: 661 - DNA, 19 bp, Artificial Sequence
  Description of Artificial Sequence: Synthetic primer
gtttccatgaagagtctga

SEQ ID NO: 662 - DNA, 19 bp, Artificial Sequence
  Description of Artificial Sequence: Synthetic primer
tcagactcttcatggaaac

SEQ ID NO: 663 - DNA, 20 bp, Artificial Sequence
  Description of Artificial Sequence: Synthetic primer
cattttcaggtgaggtctgt

SEQ ID NO: 664 - DNA, 20 bp, Artificial Sequence
  Description of Artificial Sequence: Synthetic primer
ttcaaccacaacatctagca

SEQ ID NO: 665 - DNA, 19 bp, Artificial Sequence
  Description of Artificial Sequence: Synthetic primer
acagtccactttataaacc

SEQ ID NO: 666 - DNA, 19 bp, Artificial Sequence
  Description of Artificial Sequence: Synthetic primer
actgaagtcattcattagg

SEQ ID NO: 667 - DNA, 20 bp, Artificial Sequence
  Description of Artificial Sequence: Synthetic primer
gaatgttccacctttctacc

SEQ ID NO: 668 - DNA, 19 bp, Artificial Sequence
  Description of Artificial Sequence: Synthetic primer
acctaatgaatgacttcag

SEQ ID NO: 669 - DNA, 20 bp, Artificial Sequence
  Description of Artificial Sequence: Synthetic primer
atgcattcagtttccagtag

SEQ ID NO: 670 - DNA, 19 bp, Artificial Sequence
  Description of Artificial Sequence: Synthetic primer
acttggtgaacttgaggac

SEQ ID NO: 671 - DNA, 19 bp, Artificial Sequence
  Description of Artificial Sequence: Synthetic primer
gtatatataactcctgatc

SEQ ID NO: 672 - DNA, 19 bp, Artificial Sequence
  Description of Artificial Sequence: Synthetic primer
actcagataaaagtctttc

SEQ ID NO: 673 - DNA, 21 bp, Artificial Sequence
  Description of Artificial Sequence: Synthetic primer
aataggatttaatttgttgtt

SEQ ID NO: 674 - DNA, 20 bp, Artificial Sequence
  Description of Artificial Sequence: Synthetic primer
agattttccatagagtgctg

SEQ ID NO: 675 - DNA, 18 bp, Artificial Sequence
  Description of Artificial Sequence: Synthetic primer
gcgctgccactagagctg

SEQ ID NO: 676 - DNA, 19 bp, Artificial Sequence
  Description of Artificial Sequence: Synthetic primer
ctcctcgtgggggtccacc

SEQ ID NO: 677 - DNA, 20 bp, Artificial Sequence
  Description of Artificial Sequence: Synthetic primer
ctgcttatgcacatcaacgg

SEQ ID NO: 678 - DNA, 20 bp, Artificial Sequence
  Description of Artificial Sequence: Synthetic primer
aatcttcaggcacaacgagg

SEQ ID NO: 679 - DNA, 18 bp, Artificial Sequence
  Description of Artificial Sequence: Synthetic primer
ccaggcaacggccctgat

SEQ ID NO: 680 - DNA, 19 bp, Artificial Sequence
  Description of Artificial Sequence: Synthetic primer
cgcacttggcagagtggag

SEQ ID NO: 681 - DNA, 21 bp, Artificial Sequence
  Description of Artificial Sequence: Synthetic primer
gaatcagagaatgtgatcact

SEQ ID NO: 682 - DNA, 21 bp, Artificial Sequence
  Description of Artificial Sequence: Synthetic primer
gaaaaaagactagatgcaggg

SEQ ID NO: 683 - DNA, 20 bp, Artificial Sequence
  Description of Artificial Sequence: Synthetic primer
ccagcagtccttaggattac

SEQ ID NO: 684 - DNA, 20 bp, Artificial Sequence
  Description of Artificial Sequence: Synthetic primer
tgacctgctgcctctgcttg

SEQ ID NO: 685 - DNA, 20 bp, Artificial Sequence
  Description of Artificial Sequence: Synthetic primer
aagagggaagatgacttttc

SEQ ID NO: 686 - DNA, 20 bp, Artificial Sequence
  Description of Artificial Sequence: Synthetic primer
gcaggttcacaggaagtttc

SEQ ID NO: 687 - DNA, 20 bp, Artificial Sequence
  Description of Artificial Sequence: Synthetic primer
cttcaaggcaatctttctcc

SEQ ID NO: 688 - DNA, 20 bp, Artificial Sequence
  Description of Artificial Sequence: Synthetic primer
gcaggttcacaggaagtttc

SEQ ID NO: 689 - DNA, 20 bp, Artificial Sequence
  Description of Artificial Sequence: Synthetic primer
gaaagattgccttgaagatg

SEQ ID NO: 690 - DNA, 20 bp, Artificial Sequence
  Description of Artificial Sequence: Synthetic primer
ttgccttgaagatgcaagag

SEQ ID NO: 691 - DNA, 20 bp, Artificial Sequence
  Description of Artificial Sequence: Synthetic primer
tcagagcttagctgcactgg

SEQ ID NO: 692 - DNA, 21 bp, Artificial Sequence
  Description of Artificial Sequence: Synthetic primer
caggcttcaggataattatgg

SEQ ID NO: 693 - DNA, 18 bp, Artificial Sequence
  Description of Artificial Sequence: Synthetic primer
gcacaagctgatcaagat

SEQ ID NO: 694 - DNA, 20 bp, Artificial Sequence
  Description of Artificial Sequence: Synthetic primer
catcagggaagactatcctc

SEQ ID NO: 695 - DNA, 20 bp, Artificial Sequence
  Description of Artificial Sequence: Synthetic primer
cgccatctagagaagatggg

SEQ ID NO: 696 - DNA, 19 bp, Artificial Sequence
  Description of Artificial Sequence: Synthetic primer
ctgatctaagccatcttat

SEQ ID NO: 697 - DNA, 20 bp, Artificial Sequence
  Description of Artificial Sequence: Synthetic primer
gggatgtacgtgtcattgtc

SEQ ID NO: 698 - DNA, 20 bp, Artificial Sequence
  Description of Artificial Sequence: Synthetic primer
tttgcattggcctcacagac

SEQ ID NO: 699 - DNA, 20 bp, Artificial Sequence
  Description of Artificial Sequence: Synthetic primer
atatcctggggatggatgtg

SEQ ID NO: 700 - DNA, 20 bp, Artificial Sequence
  Description of Artificial Sequence: Synthetic primer
ctgtgaggccaatgcaaatg

SEQ ID NO: 701 - DNA, 19 bp, Artificial Sequence
  Description of Artificial Sequence: Synthetic primer
cagagggtagaagggaggc

SEQ ID NO: 702 - DNA, 20 bp, Artificial Sequence
  Description of Artificial Sequence: Synthetic primer
tgtaatctagatgtagctgg

SEQ ID NO: 703 - DNA, 19 bp, Artificial Sequence
  Description of Artificial Sequence: Synthetic primer
gcctcccttctaccctctg

SEQ ID NO: 704 - DNA, 20 bp, Artificial Sequence
  Description of Artificial Sequence: Synthetic primer
actagtctcactggcagtgg

SEQ ID NO: 705 - DNA, 20 bp, Artificial Sequence
  Description of Artificial Sequence: Synthetic primer
aacagagctggaacttgcac

SEQ ID NO: 706 - DNA, 19 bp, Artificial Sequence
  Description of Artificial Sequence: Synthetic primer
ctgtcaacagagctggaac

SEQ ID NO: 707 - DNA, 20 bp, Artificial Sequence
  Description of Artificial Sequence: Synthetic primer
tgaacagcattgcaagttgg

SEQ ID NO: 708 - DNA, 20 bp, Artificial Sequence
  Description of Artificial Sequence: Synthetic primer
ttctataccccacctattct

SEQ ID NO: 709 - DNA, 20 bp, Artificial Sequence
  Description of Artificial Sequence: Synthetic primer
ttggagagagtgggagatag

SEQ ID NO: 710 - DNA, 20 bp, Artificial Sequence
  Description of Artificial Sequence: Synthetic primer
tttctataccccacctattc

SEQ ID NO: 711 - DNA, 20 bp, Artificial Sequence
  Description of Artificial Sequence: Synthetic primer
gggtatagaaaaatgtcagg

SEQ ID NO: 712 - DNA, 19 bp, Artificial Sequence
  Description of Artificial Sequence: Synthetic primer
gttacccttttaaattgct

SEQ ID NO: 713 - DNA, 20 bp, Artificial Sequence
  Description of Artificial Sequence: Synthetic primer
agggcatattccatgtcttc

SEQ ID NO: 714 - DNA, 20 bp, Artificial Sequence
  Description of Artificial Sequence: Synthetic primer
tggcaggacctgaaggatca

SEQ ID NO: 715 - DNA, 18 bp, Artificial Sequence
  Description of Artificial Sequence: Synthetic primer
gggtcctcgaagcgcacg

SEQ ID NO: 716 - DNA, 19 bp, Artificial Sequence
  Description of Artificial Sequence: Synthetic primer
tttaattgcagttgcaaac

SEQ ID NO: 717 - DNA, 20 bp, Artificial Sequence
  Description of Artificial Sequence: Synthetic primer
agggactctaggaatttcag

SEQ ID NO: 718 - DNA, 20 bp, Artificial Sequence
  Description of Artificial Sequence: Synthetic primer
ccaatggttagtcagcaaag

SEQ ID NO: 719 - DNA, 20 bp, Artificial Sequence
  Description of Artificial Sequence: Synthetic primer
agggactctaggaatttcag

SEQ ID NO: 720 - DNA, 20 bp, Artificial Sequence
  Description of Artificial Sequence: Synthetic primer
cactgtataacatagcctac

SEQ ID NO: 721 - DNA, 19 bp, Artificial Sequence
  Description of Artificial Sequence: Synthetic primer
cttatttggtgtgctgttg

SEQ ID NO: 722 - DNA, 20 bp, Artificial Sequence
  Description of Artificial Sequence: Synthetic primer
agtcccacaggcgcctacct

SEQ ID NO: 723 - DNA, 19 bp, Artificial Sequence
  Description of Artificial Sequence: Synthetic primer
cttatttggtgtgctgttg

SEQ ID NO: 724 - DNA, 20 bp, Artificial Sequence
  Description of Artificial Sequence: Synthetic primer
gaggcacctgcgaaagaaag

SEQ ID NO: 725 - DNA, 20 bp, Artificial Sequence
  Description of Artificial Sequence: Synthetic primer
ggtctaaatgtcagtgtagc

SEQ ID NO: 726 - DNA, 20 bp, Artificial Sequence
  Description of Artificial Sequence: Synthetic primer
acataaaccctgctgcttcc

SEQ ID NO: 727 - DNA, 20 bp, Artificial Sequence
  Description of Artificial Sequence: Synthetic primer
gacctactagaaggtaactg

SEQ ID NO: 728 - DNA, 20 bp, Artificial Sequence
  Description of Artificial Sequence: Synthetic primer
ggaaacatacgatgctttgc

SEQ ID NO: 729 - DNA, 20 bp, Artificial Sequence
  Description of Artificial Sequence: Synthetic primer
agaggaagagcaaaagcctg

SEQ ID NO: 730 - DNA, 21 bp, Artificial Sequence
  Description of Artificial Sequence: Synthetic primer
ccattcaatggaatagacaag

SEQ ID NO: 731 - DNA, 20 bp, Artificial Sequence
  Description of Artificial Sequence: Synthetic primer
agggttaatgaccagggctc

SEQ ID NO: 732 - DNA, 20 bp, Artificial Sequence
  Description of Artificial Sequence: Synthetic primer
gacaacttctgagaatcagg

SEQ ID NO: 733 - DNA, 20 bp, Artificial Sequence
  Description of Artificial Sequence: Synthetic primer
attctgaatgacgagccctg

SEQ ID NO: 734 - DNA, 20 bp, Artificial Sequence
  Description of Artificial Sequence: Synthetic primer
tgtttcccttccttatcctt

SEQ ID NO: 735 - DNA, 21 bp, Artificial Sequence
  Description of Artificial Sequence: Synthetic primer
gagttctagtttggcaaactt

SEQ ID NO: 736 - DNA, 20 bp, Artificial Sequence
  Description of Artificial Sequence: Synthetic primer
agcctcaggcctttctatac

SEQ ID NO: 737 - DNA, 20 bp, Artificial Sequence
  Description of Artificial Sequence: Synthetic primer
gtctttgtgttatctctggc

SEQ ID NO: 738 - DNA, 20 bp, Artificial Sequence
  Description of Artificial Sequence: Synthetic primer
ttgtgtgtaggattatgagc

SEQ ID NO: 739 - DNA, 20 bp, Artificial Sequence
  Description of Artificial Sequence: Synthetic primer
ggatcattggccaaccatac

SEQ ID NO: 740 - DNA, 20 bp, Artificial Sequence
  Description of Artificial Sequence: Synthetic primer
ctgaatgtggatttggccag

SEQ ID NO: 741 - DNA, 20 bp, Artificial Sequence
  Description of Artificial Sequence: Synthetic primer
ttaccaagagattggtggag

SEQ ID NO: 742 - DNA, 20 bp, Artificial Sequence
  Description of Artificial Sequence: Synthetic primer
actccaccaatctcttggta

SEQ ID NO: 743 - DNA, 20 bp, Artificial Sequence
  Description of Artificial Sequence: Synthetic primer
agctgtgtgcatccttttag

SEQ ID NO: 744 - DNA, 20 bp, Artificial Sequence
  Description of Artificial Sequence: Synthetic primer
gaagttgctgctgatcttgg

SEQ ID NO: 745 - DNA, 20 bp, Artificial Sequence
  Description of Artificial Sequence: Synthetic primer
cttctaggacttgtctattg

SEQ ID NO: 746 - DNA, 20 bp, Artificial Sequence
  Description of Artificial Sequence: Synthetic primer
ccaagacaggctttctgttg

SEQ ID NO: 747 - DNA, 19 bp, Artificial Sequence
  Description of Artificial Sequence: Synthetic primer
accatatagcagttggtaa

SEQ ID NO: 748 - DNA, 21 bp, Artificial Sequence
  Description of Artificial Sequence: Synthetic primer
gagatatacttatgacatggc

SEQ ID NO: 749 - DNA, 20 bp, Artificial Sequence
  Description of Artificial Sequence: Synthetic primer
gatatgacaaactgtgtgac

SEQ ID NO: 750 - DNA, 20 bp, Artificial Sequence
  Description of Artificial Sequence: Synthetic primer
gtcacacagtttgtcatatc

SEQ ID NO: 751 - DNA, 20 bp, Artificial Sequence
  Description of Artificial Sequence: Synthetic primer
aatacacaaaagatatgtag

SEQ ID NO: 752 - DNA, 20 bp, Artificial Sequence
  Description of Artificial Sequence: Synthetic primer
tcttggcggacgtccagaac

SEQ ID NO: 753 - DNA, 19 bp, Artificial Sequence
  Description of Artificial Sequence: Synthetic primer
gggttcatgctgtagctga

SEQ ID NO: 754 - DNA, 20 bp, Artificial Sequence
  Description of Artificial Sequence: Synthetic primer
cagatgggtacaagcaagtg

SEQ ID NO: 755 - DNA, 20 bp, Artificial Sequence
  Description of Artificial Sequence: Synthetic primer
ccaaggccacgttcaagact

SEQ ID NO: 756 - DNA, 20 bp, Artificial Sequence
  Description of Artificial Sequence: Synthetic primer
gctgtcatggtttcttgtaa

SEQ ID NO: 757 - DNA, 20 bp, Artificial Sequence
  Description of Artificial Sequence: Synthetic primer
ctgaaagacttccatttctg

SEQ ID NO: 758 - DNA, 20 bp, Artificial Sequence
  Description of Artificial Sequence: Synthetic primer
gcttgaatgatagtttaaag

SEQ ID NO: 759 - DNA, 20 bp, Artificial Sequence
  Description of Artificial Sequence: Synthetic primer
caacccaagttagatggagc

SEQ ID NO: 760 - DNA, 20 bp, Artificial Sequence
  Description of Artificial Sequence: Synthetic primer
ctagctactttaaaaggaac

SEQ ID NO: 761 - DNA, 19 bp, Artificial Sequence
  Description of Artificial Sequence: Synthetic primer
cttttcatagaacagagga

SEQ ID NO: 762 - DNA, 18 bp, Artificial Sequence
  Description of Artificial Sequence: Synthetic primer
gatgagagaaccaaaagc

SEQ ID NO: 763 - DNA, 18 bp, Artificial Sequence
  Description of Artificial Sequence: Synthetic primer
tttaggggattctccttc

SEQ ID NO: 764 - DNA, 19 bp, Artificial Sequence
  Description of Artificial Sequence: Synthetic primer
gctatgagatttcaaaccc

SEQ ID NO: 765 - DNA, 20 bp, Artificial Sequence
  Description of Artificial Sequence: Synthetic primer
tgacccattcccaaaatgaa

SEQ ID NO: 766 - DNA, 20 bp, Artificial Sequence
  Description of Artificial Sequence: Synthetic primer
actgggagaaattggtagtg

SEQ ID NO: 767 - DNA, 20 bp, Artificial Sequence
  Description of Artificial Sequence: Synthetic primer
cagtacttgaccattgaagc

SEQ ID NO: 768 - DNA, 20 bp, Artificial Sequence
  Description of Artificial Sequence: Synthetic primer
gagtcacattccaattcagc

SEQ ID NO: 769 - DNA, 18 bp, Artificial Sequence
  Description of Artificial Sequence: Synthetic primer
agaacttgttatagcagg

SEQ ID NO: 770 - DNA, 20 bp, Artificial Sequence
  Description of Artificial Sequence: Synthetic primer
gaaaaagaccatgtactacc

SEQ ID NO: 771 - DNA, 21 bp, Artificial Sequence
  Description of Artificial Sequence: Synthetic primer
aattatatatgacttaaagac

SEQ ID NO: 772 - DNA, 20 bp, Artificial Sequence
  Description of Artificial Sequence: Synthetic primer
gctaggtgcataactggtag

SEQ ID NO: 773 - DNA, 20 bp, Artificial Sequence
  Description of Artificial Sequence: Synthetic primer
tggtgatttcagtaggcttg

SEQ ID NO: 774 - DNA, 20 bp, Artificial Sequence
  Description of Artificial Sequence: Synthetic primer
ctatggtgatttcagtaggc

SEQ ID NO: 775 - DNA, 20 bp, Artificial Sequence
  Description of Artificial Sequence: Synthetic primer
ctaccagttatgcacctagc

SEQ ID NO: 776 - DNA, 20 bp, Artificial Sequence
  Description of Artificial Sequence: Synthetic primer
gtcttccaaaatttttcacc

SEQ ID NO: 777 - DNA, 20 bp, Artificial Sequence
  Description of Artificial Sequence: Synthetic primer
gtgcatgacaatgctcactg

SEQ ID NO: 778 - DNA, 19 bp, Artificial Sequence
  Description of Artificial Sequence: Synthetic primer
aaattgtctggaggcccat

SEQ ID NO: 779 - DNA, 20 bp, Artificial Sequence
  Description of Artificial Sequence: Synthetic primer
gcattcatgctgtgcatgac

SEQ ID NO: 780 - DNA, 20 bp, Artificial Sequence
  Description of Artificial Sequence: Synthetic primer
agacaagggagaagtctcag

SEQ ID NO: 781 - DNA, 20 bp, Artificial Sequence
  Description of Artificial Sequence: Synthetic primer
agacaagggagaagtctcag

SEQ ID NO: 782 - DNA, 20 bp, Artificial Sequence
  Description of Artificial Sequence: Synthetic primer
gcattttgggagttaactac

SEQ ID NO: 783 - DNA, 20 bp, Artificial Sequence
  Description of Artificial Sequence: Synthetic primer
tatttcaagaataactaagg

SEQ ID NO: 784 - DNA, 21 bp, Artificial Sequence
  Description of Artificial Sequence: Synthetic primer
cttctcaaactaaattatatc

SEQ ID NO: 785 - DNA, 20 bp, Artificial Sequence
  Description of Artificial Sequence: Synthetic primer
attggtggttagaatgaagg

SEQ ID NO: 786 - DNA, 19 bp, Artificial Sequence
  Description of Artificial Sequence: Synthetic primer
ggtgcaacataaagtcaaa

SEQ ID NO: 787 - DNA, 20 bp, Artificial Sequence
  Description of Artificial Sequence: Synthetic primer
ccacattcatattgagtgga

SEQ ID NO: 788 - DNA, 20 bp, Artificial Sequence
  Description of Artificial Sequence: Synthetic primer
ccagaggtattttcagaggg

SEQ ID NO: 789 - DNA, 20 bp, Artificial Sequence
  Description of Artificial Sequence: Synthetic primer
gcctctaaaagtccagcaag

SEQ ID NO: 790 - DNA, 20 bp, Artificial Sequence
  Description of Artificial Sequence: Synthetic primer
tgcatttgctgcaaaaaggg

SEQ ID NO: 791 - DNA, 20 bp, Artificial Sequence
  Description of Artificial Sequence: Synthetic primer
tctgcttgcttgccagtgtc

SEQ ID NO: 792 - DNA, 20 bp, Artificial Sequence
  Description of Artificial Sequence: Synthetic primer
tatccctgcaggcgcatatc

SEQ ID NO: 793 - DNA, 20 bp, Artificial Sequence
  Description of Artificial Sequence: Synthetic primer
agatgcacacaaacctcctc

SEQ ID NO: 794 - DNA, 20 bp, Artificial Sequence
  Description of Artificial Sequence: Synthetic primer
atggaaacatccttctgcgg

SEQ ID NO: 795 - DNA, 21 bp, Artificial Sequence
  Description of Artificial Sequence: Synthetic primer
gatttgtatgaacaaatgccc

SEQ ID NO: 796 - DNA, 20 bp, Artificial Sequence
  Description of Artificial Sequence: Synthetic primer
atggaaacatccttctgcgg

SEQ ID NO: 797 - DNA, 18 bp, Artificial Sequence
  Description of Artificial Sequence: Synthetic primer
aaggggctgggaaatatc

SEQ ID NO: 798 - DNA, 18 bp, Artificial Sequence
  Description of Artificial Sequence: Synthetic primer
aaggggctgggaaatatc

SEQ ID NO: 799 - DNA, 20 bp, Artificial Sequence
  Description of Artificial Sequence: Synthetic primer
acacagaggcccagggatga

SEQ ID NO: 800 - DNA, 20 bp, Artificial Sequence
  Description of Artificial Sequence: Synthetic primer
atacgggatggtcaacttgg

SEQ ID NO: 801 - DNA, 20 bp, Artificial Sequence
  Description of Artificial Sequence: Synthetic primer
actgtcagctatacgggatg

SEQ ID NO: 802 - DNA, 20 bp, Artificial Sequence
  Description of Artificial Sequence: Synthetic primer
cagatgatgttccgacacag

SEQ ID NO: 803 - DNA, 20 bp, Artificial Sequence
  Description of Artificial Sequence: Synthetic primer
agttgaccatcccgtatagc

SEQ ID NO: 804 - DNA, 20 bp, Artificial Sequence
  Description of Artificial Sequence: Synthetic primer
ggacagagagagctgaatac

SEQ ID NO: 805 - DNA, 20 bp, Artificial Sequence
  Description of Artificial Sequence: Synthetic primer
cttgatattcagaatgctgg

SEQ ID NO: 806 - DNA, 20 bp, Artificial Sequence
  Description of Artificial Sequence: Synthetic primer
atgatgagaagctggtgctg

SEQ ID NO: 807 - DNA, 20 bp, Artificial Sequence
  Description of Artificial Sequence: Synthetic primer
ctgttgtgaccagcattctg

SEQ ID NO: 808 - DNA, 19 bp, Artificial Sequence
  Description of Artificial Sequence: Synthetic primer
ttcagcaccagcttctcat

SEQ ID NO: 809 - DNA, 20 bp, Artificial Sequence
  Description of Artificial Sequence: Synthetic primer
tgtgcttactttaatcaggc

SEQ ID NO: 810 - DNA, 20 bp, Artificial Sequence
  Description of Artificial Sequence: Synthetic primer
ggtatctgtgctgagtcttc

SEQ ID NO: 811 - DNA, 20 bp, Artificial Sequence
  Description of Artificial Sequence: Synthetic primer
atcactatcagctcaggcac

SEQ ID NO: 812 - DNA, 20 bp, Artificial Sequence
  Description of Artificial Sequence: Synthetic primer
aacttggacagtggcgttag

SEQ ID NO: 813 - DNA, 20 bp, Artificial Sequence
  Description of Artificial Sequence: Synthetic primer
ttcccagtatgagagactgc

SEQ ID NO: 814 - DNA, 20 bp, Artificial Sequence
  Description of Artificial Sequence: Synthetic primer
gaatgtagctgttgttaggg

SEQ ID NO: 815 - DNA, 20 bp, Artificial Sequence
  Description of Artificial Sequence: Synthetic primer
cagtggcataaaacatctgg

SEQ ID NO: 816 - DNA, 20 bp, Artificial Sequence
  Description of Artificial Sequence: Synthetic primer
ccagatgttttatgccactg

SEQ ID NO: 817 - DNA, 20 bp, Artificial Sequence
  Description of Artificial Sequence: Synthetic primer
ttttctaggcccaggtcttg

SEQ ID NO: 818 - DNA, 20 bp, Artificial Sequence
  Description of Artificial Sequence: Synthetic primer
ttgttttctaggcccaggtc

SEQ ID NO: 819 - DNA, 20 bp, Artificial Sequence
  Description of Artificial Sequence: Synthetic primer
gctggtctaacagcataagg

SEQ ID NO: 820 - DNA, 20 bp, Artificial Sequence
  Description of Artificial Sequence: Synthetic primer
gaggctcaaggtttgctttc

SEQ ID NO: 821 - DNA, 20 bp, Artificial Sequence
  Description of Artificial Sequence: Synthetic primer
cctggtcatggaatagtctc

SEQ ID NO: 822 - DNA, 20 bp, Artificial Sequence
  Description of Artificial Sequence: Synthetic primer
agagtcacaggtaatgaccc

SEQ ID NO: 823 - DNA, 20 bp, Artificial Sequence
  Description of Artificial Sequence: Synthetic primer
tgaaacatgagactcagggc

SEQ ID NO: 824 - DNA, 20 bp, Artificial Sequence
  Description of Artificial Sequence: Synthetic primer
aaggtttcaggatctgggag

SEQ ID NO: 825 - DNA, 19 bp, Artificial Sequence
  Description of Artificial Sequence: Synthetic primer
aggtgagagactgcaggtg

SEQ ID NO: 826 - DNA, 20 bp, Artificial Sequence
  Description of Artificial Sequence: Synthetic primer
ccacatcccctttcaatttc

SEQ ID NO: 827 - DNA, 20 bp, Artificial Sequence
  Description of Artificial Sequence: Synthetic primer
ggactccttttgtaccactg

SEQ ID NO: 828 - DNA, 20 bp, Artificial Sequence
  Description of Artificial Sequence: Synthetic primer
tcacagtggtacaaaaggag

SEQ ID NO: 829 - DNA, 20 bp, Artificial Sequence
  Description of Artificial Sequence: Synthetic primer
ggtacaaaaggagtcctcag

SEQ ID NO: 830 - DNA, 20 bp, Artificial Sequence
  Description of Artificial Sequence: Synthetic primer
accaggagcggtgactcaac

SEQ ID NO: 831 - DNA, 20 bp, Artificial Sequence
  Description of Artificial Sequence: Synthetic primer
ccattgtgaactttcctggc

SEQ ID NO: 832 - DNA, 20 bp, Artificial Sequence
  Description of Artificial Sequence: Synthetic primer
actggggaaaaaccttgtgc

SEQ ID NO: 833 - DNA, 20 bp, Artificial Sequence
  Description of Artificial Sequence: Synthetic primer
tggagaatctccagctccag

SEQ ID NO: 834 - DNA, 20 bp, Artificial Sequence
  Description of Artificial Sequence: Synthetic primer
agccaaggaacaaattcccc

SEQ ID NO: 835 - DNA, 20 bp, Artificial Sequence
  Description of Artificial Sequence: Synthetic primer
tttgctgacagctttgcagg

SEQ ID NO: 836 - DNA, 20 bp, Artificial Sequence
  Description of Artificial Sequence: Synthetic primer
ttcatgtttcctccagggac

SEQ ID NO: 837 - DNA, 20 bp, Artificial Sequence
  Description of Artificial Sequence: Synthetic primer
taaggttcctgtcccgaatg

SEQ ID NO: 838 - DNA, 20 bp, Artificial Sequence
  Description of Artificial Sequence: Synthetic primer
gattcctgagactgttctcc

SEQ ID NO: 839 - DNA, 20 bp, Artificial Sequence
  Description of Artificial Sequence: Synthetic primer
cttccctttagcattataac

SEQ ID NO: 840 - DNA, 20 bp, Artificial Sequence
  Description of Artificial Sequence: Synthetic primer
tagtgagggctcatcactac

SEQ ID NO: 841 - DNA, 20 bp, Artificial Sequence
  Description of Artificial Sequence: Synthetic primer
cacagcttggtgcaaatgag

SEQ ID NO: 842 - DNA, 20 bp, Artificial Sequence
  Description of Artificial Sequence: Synthetic primer
ctgtgagaagattcacggac

SEQ ID NO: 843 - DNA, 20 bp, Artificial Sequence
  Description of Artificial Sequence: Synthetic primer
gggagattttgcgacttttc

SEQ ID NO: 844 - DNA, 19 bp, Artificial Sequence
  Description of Artificial Sequence: Synthetic primer
tctcccctcccggggctaa

SEQ ID NO: 845 - DNA, 19 bp, Artificial Sequence
  Description of Artificial Sequence: Synthetic primer
taccaaatattcaagtgag

SEQ ID NO: 846 - DNA, 19 bp, Artificial Sequence
  Description of Artificial Sequence: Synthetic primer
gggccagaagttctcgagc

SEQ ID NO: 847 - DNA, 19 bp, Artificial Sequence
  Description of Artificial Sequence: Synthetic primer
cacatgctgtcagctaatt

SEQ ID NO: 848 - DNA, 19 bp, Artificial Sequence
  Description of Artificial Sequence: Synthetic primer
gggtcttattccaggagaa

SEQ ID NO: 849 - DNA, 20 bp, Artificial Sequence
  Description of Artificial Sequence: Synthetic primer
tttacttgcaggcagttttc

SEQ ID NO: 850 - DNA, 20 bp, Artificial Sequence
  Description of Artificial Sequence: Synthetic primer
tctccagtatctcagttccc

SEQ ID NO: 851 - DNA, 19 bp, Artificial Sequence
  Description of Artificial Sequence: Synthetic primer
ttcttctgtcacactgtaa

SEQ ID NO: 852 - DNA, 18 bp, Artificial Sequence
  Description of Artificial Sequence: Synthetic primer
tgtgaccacctgccagtc

SEQ ID NO: 853 - DNA, 20 bp, Artificial Sequence
  Description of Artificial Sequence: Synthetic primer
caagtactgtgtgcaggatg

SEQ ID NO: 854 - DNA, 19 bp, Artificial Sequence
  Description of Artificial Sequence: Synthetic primer
aattattgaatctggttgg

SEQ ID NO: 855 - DNA, 20 bp, Artificial Sequence
  Description of Artificial Sequence: Synthetic primer
cattaatgttcagattccat

SEQ ID NO: 856 - DNA, 19 bp, Artificial Sequence
  Description of Artificial Sequence: Synthetic primer
acttgtatggaatctgaac

SEQ ID NO: 857 - DNA, 20 bp, Artificial Sequence
  Description of Artificial Sequence: Synthetic primer
cactcaatatgacctccttc

SEQ ID NO: 858 - DNA, 20 bp, Artificial Sequence
  Description of Artificial Sequence: Synthetic primer
ttgcaaaagtggagcttggg

SEQ ID NO: 859 - DNA, 19 bp, Artificial Sequence
  Description of Artificial Sequence: Synthetic primer
agagctcctggtgggacag

SEQ ID NO: 860 - DNA, 19 bp, Artificial Sequence
  Description of Artificial Sequence: Synthetic primer
cactttgctgttgaaattc

SEQ ID NO: 861 - DNA, 20 bp, Artificial Sequence
  Description of Artificial Sequence: Synthetic primer
aagagccactgcttggagag

SEQ ID NO: 862 - DNA, 19 bp, Artificial Sequence
  Description of Artificial Sequence: Synthetic primer
gaattggtggaggaccctt

SEQ ID NO: 863 - DNA, 20 bp, Artificial Sequence
  Description of Artificial Sequence: Synthetic primer
ttgtgatgatggtaacaagg

SEQ ID NO: 864 - DNA, 19 bp, Artificial Sequence
  Description of Artificial Sequence: Synthetic primer
cagtatgcaattatgacac

SEQ ID NO: 865 - DNA, 20 bp, Artificial Sequence
  Description of Artificial Sequence: Synthetic primer
gcttgactggtctgtcttac

SEQ ID NO: 866 - DNA, 20 bp, Artificial Sequence
  Description of Artificial Sequence: Synthetic primer
caagtaatttcaaacttgac

SEQ ID NO: 867 - DNA, 20 bp, Artificial Sequence
  Description of Artificial Sequence: Synthetic primer
ctctagaggagtcataagcc

SEQ ID NO: 868 - DNA, 20 bp, Artificial Sequence
  Description of Artificial Sequence: Synthetic primer
tggaagtcattcttgaagtg

SEQ ID NO: 869 - DNA, 20 bp, Artificial Sequence
  Description of Artificial Sequence: Synthetic primer
tcatagcactgccctactac

SEQ ID NO: 870 - DNA, 20 bp, Artificial Sequence
  Description of Artificial Sequence: Synthetic primer
gtagtagggcagtgctatga

SEQ ID NO: 871 - DNA, 19 bp, Artificial Sequence
  Description of Artificial Sequence: Synthetic primer
tcaaacactttcacaatgt

SEQ ID NO: 872 - DNA, 20 bp, Artificial Sequence
  Description of Artificial Sequence: Synthetic primer
gagcttgatcctgattcttc

SEQ ID NO: 873 - DNA, 19 bp, Artificial Sequence
  Description of Artificial Sequence: Synthetic primer
ccctacgacctgtcagaaa

SEQ ID NO: 874 - DNA, 20 bp, Artificial Sequence
  Description of Artificial Sequence: Synthetic primer
caggatcaagctctcaaaat

SEQ ID NO: 875 - DNA, 19 bp, Artificial Sequence
  Description of Artificial Sequence: Synthetic primer
tttctgacaggtcgtaggg

SEQ ID NO: 876 - DNA, 20 bp, Artificial Sequence
  Description of Artificial Sequence: Synthetic primer
gctcatcctatcatgatgtc

SEQ ID NO: 877 - DNA, 19 bp, Artificial Sequence
  Description of Artificial Sequence: Synthetic primer
acagacagagcacctgtgg

SEQ ID NO: 878 - DNA, 20 bp, Artificial Sequence
  Description of Artificial Sequence: Synthetic primer
ctgtgtctgggccatttttg

SEQ ID NO: 879 - DNA, 20 bp, Artificial Sequence
  Description of Artificial Sequence: Synthetic primer
gtctgggccatttttggcta

SEQ ID NO: 880 - DNA, 20 bp, Artificial Sequence
  Description of Artificial Sequence: Synthetic primer
attgcttatatgtggaagcc

SEQ ID NO: 881 - DNA, 20 bp, Artificial Sequence
  Description of Artificial Sequence: Synthetic primer
tcttctagtgcttggaaatc

SEQ ID NO: 882 - DNA, 20 bp, Artificial Sequence
  Description of Artificial Sequence: Synthetic primer
ctccgaaaagccttgaactg

SEQ ID NO: 883 - DNA, 20 bp, Artificial Sequence
  Description of Artificial Sequence: Synthetic primer
aagggaatgtggaagatgac

SEQ ID NO: 884 - DNA, 19 bp, Artificial Sequence
  Description of Artificial Sequence: Synthetic primer
catcattgggttaccaaaa

SEQ ID NO: 885 - DNA, 20 bp, Artificial Sequence
  Description of Artificial Sequence: Synthetic primer
ttcctgtagacaaccatggg

SEQ ID NO: 886 - DNA, 20 bp, Artificial Sequence
  Description of Artificial Sequence: Synthetic primer
ggattgaagatttcctccac

SEQ ID NO: 887 - DNA, 19 bp, Artificial Sequence
  Description of Artificial Sequence: Synthetic primer
tatgtggaatttgaaggag

SEQ ID NO: 888 - DNA, 20 bp, Artificial Sequence
  Description of Artificial Sequence: Synthetic primer
ctatggaaaatcctgcagac

SEQ ID NO: 889 - DNA, 20 bp, Artificial Sequence
  Description of Artificial Sequence: Synthetic primer
ggtgttaaaaccctggattg

SEQ ID NO: 890 - DNA, 20 bp, Artificial Sequence
  Description of Artificial Sequence: Synthetic primer
atgaagagcccatccctgag

SEQ ID NO: 891 - DNA, 21 bp, Artificial Sequence
  Description of Artificial Sequence: Synthetic primer
gcttcgaagtgcttgaaaatg

SEQ ID NO: 892 - DNA, 19 bp, Artificial Sequence
  Description of Artificial Sequence: Synthetic primer
tgatttgtgtccacttccc

SEQ ID NO: 893 - DNA, 20 bp, Artificial Sequence
  Description of Artificial Sequence: Synthetic primer
ctggtctgcattgtatttag

SEQ ID NO: 894 - DNA, 20 bp, Artificial Sequence
  Description of Artificial Sequence: Synthetic primer
tctccacagtcctgaatatc

SEQ ID NO: 895 - DNA, 21 bp, Artificial Sequence
  Description of Artificial Sequence: Synthetic primer
gaacaaattcagataattagg

SEQ ID NO: 896 - DNA, 20 bp, Artificial Sequence
  Description of Artificial Sequence: Synthetic primer
gagagcaatctggtgtagac

SEQ ID NO: 897 - DNA, 20 bp, Artificial Sequence
  Description of Artificial Sequence: Synthetic primer
catgttctgctgctgctatg

SEQ ID NO: 898 - DNA, 20 bp, Artificial Sequence
  Description of Artificial Sequence: Synthetic primer
attgttgtctccctgtgagc

SEQ ID NO: 899 - DNA, 19 bp, Artificial Sequence
  Description of Artificial Sequence: Synthetic primer
acacaccaaggaagaactg

SEQ ID NO: 900 - DNA, 20 bp, Artificial Sequence
  Description of Artificial Sequence: Synthetic primer
gcactagaaaaaactcttcc

SEQ ID NO: 901 - DNA, 20 bp, Artificial Sequence
  Description of Artificial Sequence: Synthetic primer
gcagaggatgctatttatgg

SEQ ID NO: 902 - DNA, 20 bp, Artificial Sequence
  Description of Artificial Sequence: Synthetic primer
gtattcaaaagccacccctg

SEQ ID NO: 903 - DNA, 20 bp, Artificial Sequence
  Description of Artificial Sequence: Synthetic primer
aaagggccaggagctgagac

SEQ ID NO: 904 - DNA, 19 bp, Artificial Sequence
  Description of Artificial Sequence: Synthetic primer
cacaatactttatcactct

SEQ ID NO: 905 - DNA, 20 bp, Artificial Sequence
  Description of Artificial Sequence: Synthetic primer
agcagacttgctccaagaca

SEQ ID NO: 906 - DNA, 20 bp, Artificial Sequence
  Description of Artificial Sequence: Synthetic primer
ttcctgcacaagtggctatg

SEQ ID NO: 907 - DNA, 20 bp, Artificial Sequence
  Description of Artificial Sequence: Synthetic primer
ggtttaccaaacagaaccac

SEQ ID NO: 908 - DNA, 20 bp, Artificial Sequence
  Description of Artificial Sequence: Synthetic primer
cacttgtgcaggaagcctaa

SEQ ID NO: 909 - DNA, 22 bp, Artificial Sequence
  Description of Artificial Sequence: Synthetic primer
ctttttaaaacttaaggataag

SEQ ID NO: 910 - DNA, 20 bp, Artificial Sequence
  Description of Artificial Sequence: Synthetic primer
aaataaccagcaggtaccag

SEQ ID NO: 911 - DNA, 20 bp, Artificial Sequence
  Description of Artificial Sequence: Synthetic primer
cttgaagaaagaagttggtg

SEQ ID NO: 912 - DNA, 20 bp, Artificial Sequence
  Description of Artificial Sequence: Synthetic primer
ttgctccactttccactgac

SEQ ID NO: 913 - DNA, 20 bp, Artificial Sequence
  Description of Artificial Sequence: Synthetic primer
atcagcagccctctggaagt

SEQ ID NO: 914 - DNA, 19 bp, Artificial Sequence
  Description of Artificial Sequence: Synthetic primer
ctcatctctgtagatgcct

SEQ ID NO: 915 - DNA, 19 bp, Artificial Sequence
  Description of Artificial Sequence: Synthetic primer
ttcccgccgccaggctgag

SEQ ID NO: 916 - DNA, 20 bp, Artificial Sequence
  Description of Artificial Sequence: Synthetic primer
catgccagagcaaactgtag

SEQ ID NO: 917 - DNA, 20 bp, Artificial Sequence
  Description of Artificial Sequence: Synthetic primer
gggtttggatttatgatggg

SEQ ID NO: 918 - DNA, 20 bp, Artificial Sequence
  Description of Artificial Sequence: Synthetic primer
ctgaactgggcaccaagaga

SEQ ID NO: 919 - DNA, 20 bp, Artificial Sequence
  Description of Artificial Sequence: Synthetic primer
tgcctttcctgagtaccctc

SEQ ID NO: 920 - DNA, 20 bp, Artificial Sequence
  Description of Artificial Sequence: Synthetic primer
tgagcaggcttgattctcac

SEQ ID NO: 921 - DNA, 20 bp, Artificial Sequence
  Description of Artificial Sequence: Synthetic primer
tgctgattctggctgatggg

SEQ ID NO: 922 - DNA, 20 bp, Artificial Sequence
  Description of Artificial Sequence: Synthetic primer
ttccgtgtcagcccacaacc

SEQ ID NO: 923 - DNA, 20 bp, Artificial Sequence
  Description of Artificial Sequence: Synthetic primer
acacacacttgtccatccag

SEQ ID NO: 924 - DNA, 19 bp, Artificial Sequence
  Description of Artificial Sequence: Synthetic primer
ttatttccttgatatccac

SEQ ID NO: 925 - DNA, 21 bp, Artificial Sequence
  Description of Artificial Sequence: Synthetic primer
caggtgaaaagttctacaatg

SEQ ID NO: 926 - DNA, 22 bp, Artificial Sequence
  Description of Artificial Sequence: Synthetic primer
gttgatatatttatttatcagg

SEQ ID NO: 927 - DNA, 21 bp, Artificial Sequence
  Description of Artificial Sequence: Synthetic primer
cacaatcaagttcaacttgta

SEQ ID NO: 928 - DNA, 20 bp, Artificial Sequence
  Description of Artificial Sequence: Synthetic primer
accatctgagggtgttactg

SEQ ID NO: 929 - DNA, 20 bp, Artificial Sequence
  Description of Artificial Sequence: Synthetic primer
agcacttcaaaacagaaggg

SEQ ID NO: 930 - DNA, 19 bp, Artificial Sequence
  Description of Artificial Sequence: Synthetic primer
agaaaggttcctttcaaat

SEQ ID NO: 931 - DNA, 20 bp, Artificial Sequence
  Description of Artificial Sequence: Synthetic primer
agatattgccagccacctac

SEQ ID NO: 932 - DNA, 20 bp, Artificial Sequence
  Description of Artificial Sequence: Synthetic primer
gagggccacatttcactatg

SEQ ID NO: 933 - DNA, 20 bp, Artificial Sequence
  Description of Artificial Sequence: Synthetic primer
ttagggtaatggtgagagag

SEQ ID NO: 934 - DNA, 20 bp, Artificial Sequence
  Description of Artificial Sequence: Synthetic primer
ttagaaaagagactaaattc

SEQ ID NO: 935 - DNA, 19 bp, Artificial Sequence
  Description of Artificial Sequence: Synthetic primer
tagacgttttaggaatttg

SEQ ID NO: 936 - DNA, 19 bp, Artificial Sequence
  Description of Artificial Sequence: Synthetic primer
gaccaaagtgtatacatag

SEQ ID NO: 937 - DNA, 20 bp, Artificial Sequence
  Description of Artificial Sequence: Synthetic primer
gtgtagtaagcgggaatgag

SEQ ID NO: 938 - DNA, 21 bp, Artificial Sequence
  Description of Artificial Sequence: Synthetic primer
caataaggtggtattctctcc

SEQ ID NO: 939 - DNA, 20 bp, Artificial Sequence
  Description of Artificial Sequence: Synthetic primer
gtgtgaggcttcactaaagg

SEQ ID NO: 940 - DNA, 21 bp, Artificial Sequence
  Description of Artificial Sequence: Synthetic primer
gctgcttgttagtgaatttac

SEQ ID NO: 941 - DNA, 20 bp, Artificial Sequence
  Description of Artificial Sequence: Synthetic primer
gaaagttaacaaaagcaagg

SEQ ID NO: 942 - DNA, 20 bp, Artificial Sequence
  Description of Artificial Sequence: Synthetic primer
aggagtctctggagcagaaa

SEQ ID NO: 943 - DNA, 20 bp, Artificial Sequence
  Description of Artificial Sequence: Synthetic primer
caagaacttgctttccacag

SEQ ID NO: 944 - DNA, 19 bp, Artificial Sequence
  Description of Artificial Sequence: Synthetic primer
tttattttccttcacctgg

SEQ ID NO: 945 - DNA, 20 bp, Artificial Sequence
  Description of Artificial Sequence: Synthetic primer
actaaggctcttagtatggg

SEQ ID NO: 946 - DNA, 20 bp, Artificial Sequence
  Description of Artificial Sequence: Synthetic primer
tatatgtagcactaaggctc

SEQ ID NO: 947 - DNA, 19 bp, Artificial Sequence
  Description of Artificial Sequence: Synthetic primer
ctttaccacttttgttttg

SEQ ID NO: 948 - DNA, 20 bp, Artificial Sequence
  Description of Artificial Sequence: Synthetic primer
ggacttctccaccaaatctc

SEQ ID NO: 949 - DNA, 20 bp, Artificial Sequence
  Description of Artificial Sequence: Synthetic primer
tgtcatttggaagaggttac

SEQ ID NO: 950 - DNA, 20 bp, Artificial Sequence
  Description of Artificial Sequence: Synthetic primer
cctatattcctgaatttttt

SEQ ID NO: 951 - DNA, 20 bp, Artificial Sequence
  Description of Artificial Sequence: Synthetic primer
atatttcaagtatcactatg

SEQ ID NO: 952 - DNA, 19 bp, Artificial Sequence
  Description of Artificial Sequence: Synthetic primer
attattcctatgcatgctt

SEQ ID NO: 953 - DNA, 19 bp, Artificial Sequence
  Description of Artificial Sequence: Synthetic primer
ctacatattatctatgacc

SEQ ID NO: 954 - DNA, 19 bp, Artificial Sequence
  Description of Artificial Sequence: Synthetic primer
gtagctttaatttcaggtg

SEQ ID NO: 955 - DNA, 20 bp, Artificial Sequence
  Description of Artificial Sequence: Synthetic primer
ttggggagatgagactatta

SEQ ID NO: 956 - DNA, 19 bp, Artificial Sequence
  Description of Artificial Sequence: Synthetic primer
cagccacaaatgaatccag

SEQ ID NO: 957 - DNA, 20 bp, Artificial Sequence
  Description of Artificial Sequence: Synthetic primer
aggagcaaattatgacccag

SEQ ID NO: 958 - DNA, 19 bp, Artificial Sequence
  Description of Artificial Sequence: Synthetic primer
tttgcatgagtgaatcaag

SEQ ID NO: 959 - DNA, 21 bp, Artificial Sequence
  Description of Artificial Sequence: Synthetic primer
gagatatttgaatctaagagc

SEQ ID NO: 960 - DNA, 20 bp, Artificial Sequence
  Description of Artificial Sequence: Synthetic primer
agattgtgggtactccagag

SEQ ID NO: 961 - DNA, 20 bp, Artificial Sequence
  Description of Artificial Sequence: Synthetic primer
atagccagccaactttggag

SEQ ID NO: 962 - DNA, 20 bp, Artificial Sequence
  Description of Artificial Sequence: Synthetic primer
aagtgtgaaaacttctcgtc

SEQ ID NO: 963 - DNA, 20 bp, Artificial Sequence
  Description of Artificial Sequence: Synthetic primer
ccttttaaaatatgcacgag

SEQ ID NO: 964 - DNA, 20 bp, Artificial Sequence
  Description of Artificial Sequence: Synthetic primer
tgctgcagtagtaggaagag

SEQ ID NO: 965 - DNA, 20 bp, Artificial Sequence
  Description of Artificial Sequence: Synthetic primer
agtgcttgagcatttcatgg

SEQ ID NO: 966 - DNA, 20 bp, Artificial Sequence
  Description of Artificial Sequence: Synthetic primer
gaatcatacgtaagggaaga

SEQ ID NO: 967 - DNA, 20 bp, Artificial Sequence
  Description of Artificial Sequence: Synthetic primer
ctccttttctttcacgactg

SEQ ID NO: 968 - DNA, 20 bp, Artificial Sequence
  Description of Artificial Sequence: Synthetic primer
gtggctatgaaagacagcct

SEQ ID NO: 969 - DNA, 20 bp, Artificial Sequence
  Description of Artificial Sequence: Synthetic primer
gactctcttcatgatgactc

SEQ ID NO: 970 - DNA, 20 bp, Artificial Sequence
  Description of Artificial Sequence: Synthetic primer
agcaacataacgctttctcc

SEQ ID NO: 971 - DNA, 20 bp, Artificial Sequence
  Description of Artificial Sequence: Synthetic primer
gctatgatgcatttgccaat

SEQ ID NO: 972 - DNA, 20 bp, Artificial Sequence
  Description of Artificial Sequence: Synthetic primer
aatgtctctttcctctgctg

SEQ ID NO: 973 - DNA, 20 bp, Artificial Sequence
  Description of Artificial Sequence: Synthetic primer
tagcataacaagttggtgag

SEQ ID NO: 974 - DNA, 20 bp, Artificial Sequence
  Description of Artificial Sequence: Synthetic primer
cctctttcttcataggtagg

SEQ ID NO: 975 - DNA, 20 bp, Artificial Sequence
  Description of Artificial Sequence: Synthetic primer
ttgtgacatgataaagctgg

SEQ ID NO: 976 - DNA, 20 bp, Artificial Sequence
  Description of Artificial Sequence: Synthetic primer
aaaactgtcattcagcgact

SEQ ID NO: 977 - DNA, 21 bp, Artificial Sequence
  Description of Artificial Sequence: Synthetic primer
cagtactaagtatgaacatga

SEQ ID NO: 978 - DNA, 20 bp, Artificial Sequence
  Description of Artificial Sequence: Synthetic primer
ggtctagagaactctgaaag

SEQ ID NO: 979 - DNA, 20 bp, Artificial Sequence
  Description of Artificial Sequence: Synthetic primer
aggaagttgcactctgttgg

SEQ ID NO: 980 - DNA, 20 bp, Artificial Sequence
  Description of Artificial Sequence: Synthetic primer
tgcaactaagagacatcagc

SEQ ID NO: 981 - DNA, 20 bp, Artificial Sequence
  Description of Artificial Sequence: Synthetic primer
agctgatgtctcttagttgc

SEQ ID NO: 982 - DNA, 20 bp, Artificial Sequence
  Description of Artificial Sequence: Synthetic primer
agtctctaccacaagaacac

SEQ ID NO: 983 - DNA, 20 bp, Artificial Sequence
  Description of Artificial Sequence: Synthetic primer
tagtgaagctgtcggtagtg

SEQ ID NO: 984 - DNA, 20 bp, Artificial Sequence
  Description of Artificial Sequence: Synthetic primer
attcagcctggtgaatgaag

SEQ ID NO: 985 - DNA, 20 bp, Artificial Sequence
  Description of Artificial Sequence: Synthetic primer
caatgtctctgacactaccg

SEQ ID NO: 986 - DNA, 20 bp, Artificial Sequence
  Description of Artificial Sequence: Synthetic primer
cagatgccattagatggtgc

SEQ ID NO: 987 - DNA, 19 bp, Artificial Sequence
  Description of Artificial Sequence: Synthetic primer
ctgttaccaccttgcctgc

SEQ ID NO: 988 - DNA, 20 bp, Artificial Sequence
  Description of Artificial Sequence: Synthetic primer
tggtggcactagtacacaag

SEQ ID NO: 989 - DNA, 19 bp, Artificial Sequence
  Description of Artificial Sequence: Synthetic primer
gtttattgcaccatctaca

SEQ ID NO: 990 - DNA, 20 bp, Artificial Sequence
  Description of Artificial Sequence: Synthetic primer
tccatgttgccagtaaacac

SEQ ID NO: 991 - DNA, 20 bp, Artificial Sequence
  Description of Artificial Sequence: Synthetic primer
taaatgagcagagactcaag

SEQ ID NO: 992 - DNA, 20 bp, Artificial Sequence
  Description of Artificial Sequence: Synthetic primer
aggacgtgtaagagaaaggg

SEQ ID NO: 993 - DNA, 20 bp, Artificial Sequence
  Description of Artificial Sequence: Synthetic primer
cgtcctttgacacattttag

SEQ ID NO: 994 - DNA, 20 bp, Artificial Sequence
  Description of Artificial Sequence: Synthetic primer
ccaaacatttataatctgac

SEQ ID NO: 995 - DNA, 20 bp, Artificial Sequence
  Description of Artificial Sequence: Synthetic primer
aaccagtacagattagttgc

SEQ ID NO: 996 - DNA, 20 bp, Artificial Sequence
  Description of Artificial Sequence: Synthetic primer
gattctgactggtttcctac

SEQ ID NO: 997 - DNA, 19 bp, Artificial Sequence
  Description of Artificial Sequence: Synthetic primer
tctcatgaaaaagcagcag

SEQ ID NO: 998 - DNA, 20 bp, Artificial Sequence
  Description of Artificial Sequence: Synthetic primer
gggaagatcttaaagggagc

SEQ ID NO: 999 - DNA, 19 bp, Artificial Sequence
  Description of Artificial Sequence: Synthetic primer
ttctgcaaattaccatttc

SEQ ID NO: 1000 - DNA, 19 bp, Artificial Sequence
  Description of Artificial Sequence: Synthetic primer
tctatgcctaaaataagtg

SEQ ID NO: 1001 - DNA, 19 bp, Artificial Sequence
  Description of Artificial Sequence: Synthetic primer
gatctctgcaaagaatacc

SEQ ID NO: 1002 - DNA, 20 bp, Artificial Sequence
  Description of Artificial Sequence: Synthetic primer
caggagtatgcattttcctc

SEQ ID NO: 1003 - DNA, 20 bp, Artificial Sequence
  Description of Artificial Sequence: Synthetic primer
acaccacatttctaccactg

SEQ ID NO: 1004 - DNA, 20 bp, Artificial Sequence
  Description of Artificial Sequence: Synthetic primer
tctgtgacacagagcatgag

SEQ ID NO: 1005 - DNA, 20 bp, Artificial Sequence
  Description of Artificial Sequence: Synthetic primer
cagagctgatttgttccagt

SEQ ID NO: 1006 - DNA, 20 bp, Artificial Sequence
  Description of Artificial Sequence: Synthetic primer
aactccagggctacttgaac

SEQ ID NO: 1007 - DNA, 20 bp, Artificial Sequence
  Description of Artificial Sequence: Synthetic primer
aaagctttaacaagttggcg

SEQ ID NO: 1008 - DNA, 20 bp, Artificial Sequence
  Description of Artificial Sequence: Synthetic primer
tgatacagaaatgtcaaccc

SEQ ID NO: 1009 - DNA, 18 bp, Artificial Sequence
  Description of Artificial Sequence: Synthetic primer
tgtgacaaattctatggc

SEQ ID NO: 1010 - DNA, 20 bp, Artificial Sequence
  Description of Artificial Sequence: Synthetic primer
tgcacagttgaaaagtaacc

SEQ ID NO: 1011 - DNA, 20 bp, Artificial Sequence
  Description of Artificial Sequence: Synthetic primer
gccatttgaagaatggtatg

SEQ ID NO: 1012 - DNA, 20 bp, Artificial Sequence
  Description of Artificial Sequence: Synthetic primer
gcctaacatattgtatgcac

SEQ ID NO: 1013 - DNA, 20 bp, Artificial Sequence
  Description of Artificial Sequence: Synthetic primer
agtctgtctattgtaggatg

SEQ ID NO: 1014 - DNA, 19 bp, Artificial Sequence
  Description of Artificial Sequence: Synthetic primer
gattcatcctacaatagac

SEQ ID NO: 1015 - DNA, 20 bp, Artificial Sequence
  Description of Artificial Sequence: Synthetic primer
gtgtagtagattttctaggc

SEQ ID NO: 1016 - DNA, 20 bp, Artificial Sequence
  Description of Artificial Sequence: Synthetic primer
tcttatcacctatgttctgg

SEQ ID NO: 1017 - DNA, 21 bp, Artificial Sequence
  Description of Artificial Sequence: Synthetic primer
ccagaacataggtgataagac

SEQ ID NO: 1018 - DNA, 20 bp, Artificial Sequence
  Description of Artificial Sequence: Synthetic primer
aaaatctttatatagcttgg

SEQ ID NO: 1019 - DNA, 20 bp, Artificial Sequence
  Description of Artificial Sequence: Synthetic primer
gttcctcatgtcagctcttg

SEQ ID NO: 1020 - DNA, 20 bp, Artificial Sequence
  Description of Artificial Sequence: Synthetic primer
actcaagagctgacatgagg

SEQ ID NO: 1021 - DNA, 20 bp, Artificial Sequence
  Description of Artificial Sequence: Synthetic primer
ctgtgttgatgtggtagccc

SEQ ID NO: 1022 - DNA, 20 bp, Artificial Sequence
  Description of Artificial Sequence: Synthetic primer
gtcacccagtatatttctcc

SEQ ID NO: 1023 - DNA, 21 bp, Artificial Sequence
  Description of Artificial Sequence: Synthetic primer
tatgtgttatatttttttctg

SEQ ID NO: 1024 - DNA, 20 bp, Artificial Sequence
  Description of Artificial Sequence: Synthetic primer
ctttagaaggattttcttat

SEQ ID NO: 1025 - DNA, 21 bp, Artificial Sequence
  Description of Artificial Sequence: Synthetic primer
ccaaattaatcttccattctg

SEQ ID NO: 1026 - DNA, 20 bp, Artificial Sequence
  Description of Artificial Sequence: Synthetic primer
agtacatcattggcaccttg

SEQ ID NO: 1027 - DNA, 19 bp, Artificial Sequence
  Description of Artificial Sequence: Synthetic primer
gatggaaggagtggtagtg

SEQ ID NO: 1028 - DNA, 21 bp, Artificial Sequence
  Description of Artificial Sequence: Synthetic primer
tttttctattttaactaactg

SEQ ID NO: 1029 - DNA, 20 bp, Artificial Sequence
  Description of Artificial Sequence: Synthetic primer
tgacacatgacttttgtgcc

SEQ ID NO: 1030 - DNA, 20 bp, Artificial Sequence
  Description of Artificial Sequence: Synthetic primer
cagtattggcttattatgtc

SEQ ID NO: 1031 - DNA, 21 bp, Artificial Sequence
  Description of Artificial Sequence: Synthetic primer
ccaggtactgttgtttttgac

SEQ ID NO: 1032 - DNA, 20 bp, Artificial Sequence
  Description of Artificial Sequence: Synthetic primer
caggtgtttttggtaaccag

SEQ ID NO: 1033 - DNA, 20 bp, Artificial Sequence
  Description of Artificial Sequence: Synthetic primer
gaaaacaaatgtgcattagc

SEQ ID NO: 1034 - DNA, 19 bp, Artificial Sequence
  Description of Artificial Sequence: Synthetic primer
gcttctctaagctacttta

SEQ ID NO: 1035 - DNA, 20 bp, Artificial Sequence
  Description of Artificial Sequence: Synthetic primer
cgtctcctgagtaaactcac

SEQ ID NO: 1036 - DNA, 20 bp, Artificial Sequence
  Description of Artificial Sequence: Synthetic primer
gacagagagggttaagttct

SEQ ID NO: 1037 - DNA, 20 bp, Artificial Sequence
  Description of Artificial Sequence: Synthetic primer
ccatagcaagatgaattcac

SEQ ID NO: 1038 - DNA, 20 bp, Artificial Sequence
  Description of Artificial Sequence: Synthetic primer
ccatagcaagatgaattcac

SEQ ID NO: 1039 - DNA, 20 bp, Artificial Sequence
  Description of Artificial Sequence: Synthetic primer
accctcatatgtctggtagc

SEQ ID NO: 1040 - DNA, 20 bp, Artificial Sequence
  Description of Artificial Sequence: Synthetic primer
agttccacatgaacctagcg

SEQ ID NO: 1041 - DNA, 19 bp, Artificial Sequence
  Description of Artificial Sequence: Synthetic primer
gttgtgactattgttatag

SEQ ID NO: 1042 - DNA, 20 bp, Artificial Sequence
  Description of Artificial Sequence: Synthetic primer
gagtgtagagctgttactgg

SEQ ID NO: 1043 - DNA, 21 bp, Artificial Sequence
  Description of Artificial Sequence: Synthetic primer
ctcagattataggagacagag

SEQ ID NO: 1044 - DNA, 19 bp, Artificial Sequence
  Description of Artificial Sequence: Synthetic primer
tgatgaatacttagttccc

SEQ ID NO: 1045 - DNA, 19 bp, Artificial Sequence
  Description of Artificial Sequence: Synthetic primer
aggaaattatctacaaagg

SEQ ID NO: 1046 - DNA, 20 bp, Artificial Sequence
  Description of Artificial Sequence: Synthetic primer
cctgaagtatgttagtagac

SEQ ID NO: 1047 - DNA, 19 bp, Artificial Sequence
  Description of Artificial Sequence: Synthetic primer
tcctttgtagataatttcc

SEQ ID NO: 1048 - DNA, 20 bp, Artificial Sequence
  Description of Artificial Sequence: Synthetic primer
tttgtccttcatctcttacc

SEQ ID NO: 1049 - DNA, 22 bp, Artificial Sequence
  Description of Artificial Sequence: Synthetic primer
atattgactataacttaaatat

SEQ ID NO: 1050 - DNA, 20 bp, Artificial Sequence
  Description of Artificial Sequence: Synthetic primer
gtgattgtaaaaattatagc

SEQ ID NO: 1051 - DNA, 19 bp, Artificial Sequence
  Description of Artificial Sequence: Synthetic primer
tgctttcgaattttttcac

SEQ ID NO: 1052 - DNA, 19 bp, Artificial Sequence
  Description of Artificial Sequence: Synthetic primer
cccaaagatttaacttgat

SEQ ID NO: 1053 - DNA, 20 bp, Artificial Sequence
  Description of Artificial Sequence: Synthetic primer
ctctccatgatgtactgtag

SEQ ID NO: 1054 - DNA, 20 bp, Artificial Sequence
  Description of Artificial Sequence: Synthetic primer
agagaggagctagtcagaac

SEQ ID NO: 1055 - DNA, 21 bp, Artificial Sequence
  Description of Artificial Sequence: Synthetic primer
gatctaggttgaaactagttg

SEQ ID NO: 1056 - DNA, 20 bp, Artificial Sequence
  Description of Artificial Sequence: Synthetic primer
gttgaaactagttgggcttc

SEQ ID NO: 1057 - DNA, 20 bp, Artificial Sequence
  Description of Artificial Sequence: Synthetic primer
gcctctttcactaccatgag

SEQ ID NO: 1058 - DNA, 20 bp, Artificial Sequence
  Description of Artificial Sequence: Synthetic primer
gttaatcagagccagccaag

SEQ ID NO: 1059 - DNA, 20 bp, Artificial Sequence
  Description of Artificial Sequence: Synthetic primer
gaaggaaggtgggttctgtg

SEQ ID NO: 1060 - DNA, 20 bp, Artificial Sequence
  Description of Artificial Sequence: Synthetic primer
ctgaattctttgggaagggc

SEQ ID NO: 1061 - DNA, 20 bp, Artificial Sequence
  Description of Artificial Sequence: Synthetic primer
aaaggaacgaaagcaacggg

SEQ ID NO: 1062 - DNA, 20 bp, Artificial Sequence
  Description of Artificial Sequence: Synthetic primer
tgttcagtgctgccagtcaa

SEQ ID NO: 1063 - DNA, 20 bp, Artificial Sequence
  Description of Artificial Sequence: Synthetic primer
tgttcagtgctgccagtcaa

SEQ ID NO: 1064 - DNA, 20 bp, Artificial Sequence
  Description of Artificial Sequence: Synthetic primer
cccgcaaaagtttcaagaag

SEQ ID NO: 1065 - DNA, 20 bp, Artificial Sequence
  Description of Artificial Sequence: Synthetic primer
ttccctgattacactgtgcc

SEQ ID NO: 1066 - DNA, 20 bp, Artificial Sequence
  Description of Artificial Sequence: Synthetic primer
atgtaggcattgtaatgagg

SEQ ID NO: 1067 - DNA, 20 bp, Artificial Sequence
  Description of Artificial Sequence: Synthetic primer
agtataatattttggcattc

SEQ ID NO: 1068 - DNA, 19 bp, Artificial Sequence
  Description of Artificial Sequence: Synthetic primer
agcgcacagcgtttccgca

SEQ ID NO: 1069 - DNA, 21 bp, Artificial Sequence
  Description of Artificial Sequence: Synthetic primer
cgagtaagtaaatgtgagtgg

SEQ ID NO: 1070 - DNA, 19 bp, Artificial Sequence
  Description of Artificial Sequence: Synthetic primer
aacttgccttcaagatctg

SEQ ID NO: 1071 - DNA, 19 bp, Artificial Sequence
  Description of Artificial Sequence: Synthetic primer
tcagaacctttttgaaaac

SEQ ID NO: 1072 - DNA, 20 bp, Artificial Sequence
  Description of Artificial Sequence: Synthetic primer
ttcggtcaaggcttactatg

SEQ ID NO: 1073 - DNA, 20 bp, Artificial Sequence
  Description of Artificial Sequence: Synthetic primer
agtgtgctatactggactac

SEQ ID NO: 1074 - DNA, 20 bp, Artificial Sequence
  Description of Artificial Sequence: Synthetic primer
actcttagccctttcacagc

SEQ ID NO: 1075 - DNA, 20 bp, Artificial Sequence
  Description of Artificial Sequence: Synthetic primer
ttagccttttccctgctttg

SEQ ID NO: 1076 - DNA, 19 bp, Artificial Sequence
  Description of Artificial Sequence: Synthetic primer
gttaaaacgtggaaaatac

SEQ ID NO: 1077 - DNA, 20 bp, Artificial Sequence
  Description of Artificial Sequence: Synthetic primer
aaagaataaaacgtaaactc

SEQ ID NO: 1078 - DNA, 19 bp, Artificial Sequence
  Description of Artificial Sequence: Synthetic primer
tgcacgcagcatcaccagt

SEQ ID NO: 1079 - DNA, 20 bp, Artificial Sequence
  Description of Artificial Sequence: Synthetic primer
acacacagtaagagccactc

SEQ ID NO: 1080 - DNA, 19 bp, Artificial Sequence
  Description of Artificial Sequence: Synthetic primer
cccaccaggcacctgctct

SEQ ID NO: 1081 - DNA, 18 bp, Artificial Sequence
  Description of Artificial Sequence: Synthetic primer
agcctctgcttccccaca

SEQ ID NO: 1082 - DNA, 19 bp, Artificial Sequence
  Description of Artificial Sequence: Synthetic primer
tgaggtggcctatgttccc

SEQ ID NO: 1083 - DNA, 19 bp, Artificial Sequence
  Description of Artificial Sequence: Synthetic primer
gagtcaccaactgccccca

SEQ ID NO: 1084 - DNA, 20 bp, Artificial Sequence
  Description of Artificial Sequence: Synthetic primer
tcatagcacaagtctcaggg

SEQ ID NO: 1085 - DNA, 20 bp, Artificial Sequence
  Description of Artificial Sequence: Synthetic primer
aggagacccctcaccctatg

SEQ ID NO: 1086 - DNA, 19 bp, Artificial Sequence
  Description of Artificial Sequence: Synthetic primer
agcgcctgagtgccctgag

SEQ ID NO: 1087 - DNA, 19 bp, Artificial Sequence
  Description of Artificial Sequence: Synthetic primer
tcctgcgtcccagcaccat

SEQ ID NO: 1088 - DNA, 20 bp, Artificial Sequence
  Description of Artificial Sequence: Synthetic primer
ctgcacacttgcagggtatg

SEQ ID NO: 1089 - DNA, 20 bp, Artificial Sequence
  Description of Artificial Sequence: Synthetic primer
caagtgtgcagtctgtcctc

SEQ ID NO: 1090 - DNA, 20 bp, Artificial Sequence
  Description of Artificial Sequence: Synthetic primer
tgaggactgctctatgaccg

SEQ ID NO: 1091 - DNA, 19 bp, Artificial Sequence
  Description of Artificial Sequence: Synthetic primer
ggagataacaggtgtttcc

SEQ ID NO: 1092 - DNA, 20 bp, Artificial Sequence
  Description of Artificial Sequence: Synthetic primer
tgctcatctgaggcctcagt

SEQ ID NO: 1093 - DNA, 20 bp, Artificial Sequence
  Description of Artificial Sequence: Synthetic primer
tcgcggagatcaacttcaac

SEQ ID NO: 1094 - DNA, 20 bp, Artificial Sequence
  Description of Artificial Sequence: Synthetic primer
ttcccaggcagctcaggccg

SEQ ID NO: 1095 - DNA, 19 bp, Artificial Sequence
  Description of Artificial Sequence: Synthetic primer
aggcccctctgtggagcta

SEQ ID NO: 1096 - DNA, 19 bp, Artificial Sequence
  Description of Artificial Sequence: Synthetic primer
gccttcacctgggcagcac

SEQ ID NO: 1097 - DNA, 18 bp, Artificial Sequence
  Description of Artificial Sequence: Synthetic primer
gtcctgcaagcactggcg

SEQ ID NO: 1098 - DNA, 19 bp, Artificial Sequence
  Description of Artificial Sequence: Synthetic primer
tgggtggtgtccacctagt

SEQ ID NO: 1099 - DNA, 19 bp, Artificial Sequence
  Description of Artificial Sequence: Synthetic primer
cctagatgtcagccgtgag

SEQ ID NO: 1100 - DNA, 19 bp, Artificial Sequence
  Description of Artificial Sequence: Synthetic primer
cacaggcctgatgcccacc

SEQ ID NO: 1101 - DNA, 20 bp, Artificial Sequence
  Description of Artificial Sequence: Synthetic primer
aaggagaggggtcttatcag

SEQ ID NO: 1102 - DNA, 20 bp, Artificial Sequence
  Description of Artificial Sequence: Synthetic primer
accctcacggctgacatcta

SEQ ID NO: 1103 - DNA, 20 bp, Artificial Sequence
  Description of Artificial Sequence: Synthetic primer
acgtcccagataggaggaag

SEQ ID NO: 1104 - DNA, 20 bp, Artificial Sequence
  Description of Artificial Sequence: Synthetic primer
tcatccttgaggccagggag

SEQ ID NO: 1105 - DNA, 19 bp, Artificial Sequence
  Description of Artificial Sequence: Synthetic primer
tttctgctggtaacaaatg

SEQ ID NO: 1106 - DNA, 20 bp, Artificial Sequence
  Description of Artificial Sequence: Synthetic primer
tcctgcagaggcctagcctt

SEQ ID NO: 1107 - DNA, 20 bp, Artificial Sequence
  Description of Artificial Sequence: Synthetic primer
tgacactgggcatagtgtgg

SEQ ID NO: 1108 - DNA, 18 bp, Artificial Sequence
  Description of Artificial Sequence: Synthetic primer
ttgggatcatggcacagg

SEQ ID NO: 1109 - DNA, 19 bp, Artificial Sequence
  Description of Artificial Sequence: Synthetic primer
tgatgacctcaaacctccg

SEQ ID NO: 1110 - DNA, 20 bp, Artificial Sequence
  Description of Artificial Sequence: Synthetic primer
ttctttgttcgtgggtagtg

SEQ ID NO: 1111 - DNA, 20 bp, Artificial Sequence
  Description of Artificial Sequence: Synthetic primer
tgcctgttaccaggtactac

SEQ ID NO: 1112 - DNA, 20 bp, Artificial Sequence
  Description of Artificial Sequence: Synthetic primer
ctgattatctttttctaagc

SEQ ID NO: 1113 - DNA, 20 bp, Artificial Sequence
  Description of Artificial Sequence: Synthetic primer
aatctgggtttccttgaggg

SEQ ID NO: 1114 - DNA, 20 bp, Artificial Sequence
  Description of Artificial Sequence: Synthetic primer
gcaactgactgtcataagag

SEQ ID NO: 1115 - DNA, 20 bp, Artificial Sequence
  Description of Artificial Sequence: Synthetic primer
ggaagaatctgagaagtagc

SEQ ID NO: 1116 - DNA, 20 bp, Artificial Sequence
  Description of Artificial Sequence: Synthetic primer
agctcttagttcctccagac

SEQ ID NO: 1117 - DNA, 20 bp, Artificial Sequence
  Description of Artificial Sequence: Synthetic primer
gcagcccagatcttggttac

SEQ ID NO: 1118 - DNA, 20 bp, Artificial Sequence
  Description of Artificial Sequence: Synthetic primer
tcctagactctttcctgtgg

SEQ ID NO: 1119 - DNA, 20 bp, Artificial Sequence
  Description of Artificial Sequence: Synthetic primer
tgagattgagttcgctcctg

SEQ ID NO: 1120 - DNA, 20 bp, Artificial Sequence
  Description of Artificial Sequence: Synthetic primer
aaggacacctgacaagatag

SEQ ID NO: 1121 - DNA, 20 bp, Artificial Sequence
  Description of Artificial Sequence: Synthetic primer
agaatcagagtccagctcag

SEQ ID NO: 1122 - DNA, 20 bp, Artificial Sequence
  Description of Artificial Sequence: Synthetic primer
gacccacaaatatgagtcag

SEQ ID NO: 1123 - DNA, 20 bp, Artificial Sequence
  Description of Artificial Sequence: Synthetic primer
ggaaatggattacagccctc

SEQ ID NO: 1124 - DNA, 20 bp, Artificial Sequence
  Description of Artificial Sequence: Synthetic primer
gggctgtaatccatttcctg

SEQ ID NO: 1125 - DNA, 19 bp, Artificial Sequence
  Description of Artificial Sequence: Synthetic primer
tctctttccattccagtga

SEQ ID NO: 1126 - DNA, 20 bp, Artificial Sequence
  Description of Artificial Sequence: Synthetic primer
gtgtaagagagaggaccttt

SEQ ID NO: 1127 - DNA, 20 bp, Artificial Sequence
  Description of Artificial Sequence: Synthetic primer
tcccttgaatgttggaagga

SEQ ID NO: 1128 - DNA, 20 bp, Artificial Sequence
  Description of Artificial Sequence: Synthetic primer
agagccagttttgcattcac

SEQ ID NO: 1129 - DNA, 20 bp, Artificial Sequence
  Description of Artificial Sequence: Synthetic primer
tcagaatgggtctgagtttc

SEQ ID NO: 1130 - DNA, 20 bp, Artificial Sequence
  Description of Artificial Sequence: Synthetic primer
catgggctaagccatgtaag

SEQ ID NO: 1131 - DNA, 20 bp, Artificial Sequence
  Description of Artificial Sequence: Synthetic primer
cacattcaggagcagctatg

SEQ ID NO: 1132 - DNA, 20 bp, Artificial Sequence
  Description of Artificial Sequence: Synthetic primer
ctaaatcaaattactgtgcc

SEQ ID NO: 1133 - DNA, 20 bp, Artificial Sequence
  Description of Artificial Sequence: Synthetic primer
ttggctccagtcactttcag

SEQ ID NO: 1134 - DNA, 20 bp, Artificial Sequence
  Description of Artificial Sequence: Synthetic primer
ccttcataacgttatacacc

SEQ ID NO: 1135 - DNA, 20 bp, Artificial Sequence
  Description of Artificial Sequence: Synthetic primer
tgaaagtgactggagccaag

SEQ ID NO: 1136 - DNA, 20 bp, Artificial Sequence
  Description of Artificial Sequence: Synthetic primer
tgcgtgtcagaagatgctac

SEQ ID NO: 1137 - DNA, 20 bp, Artificial Sequence
  Description of Artificial Sequence: Synthetic primer
actcgcagactaggtcccgt

SEQ ID NO: 1138 - DNA, 20 bp, Artificial Sequence
  Description of Artificial Sequence: Synthetic primer
acgggacctagtctgcgagt

SEQ ID NO: 1139 - DNA, 20 bp, Artificial Sequence
  Description of Artificial Sequence: Synthetic primer
cttgctgacattccccaaag

SEQ ID NO: 1140 - DNA, 20 bp, Artificial Sequence
  Description of Artificial Sequence: Synthetic primer
caaattgccatccactgctc

SEQ ID NO: 1141 - DNA, 20 bp, Artificial Sequence
  Description of Artificial Sequence: Synthetic primer
gagcagtggatggcaatttg

SEQ ID NO: 1142 - DNA, 20 bp, Artificial Sequence
  Description of Artificial Sequence: Synthetic primer
agcagaaaataatcccctgg

SEQ ID NO: 1143 - DNA, 20 bp, Artificial Sequence
  Description of Artificial Sequence: Synthetic primer
agcacaaacgcccttattag

SEQ ID NO: 1144 - DNA, 20 bp, Artificial Sequence
  Description of Artificial Sequence: Synthetic primer
gatggcccaagatacaaacc

SEQ ID NO: 1145 - DNA, 20 bp, Artificial Sequence
  Description of Artificial Sequence: Synthetic primer
tgtgtcctctggaagattac

SEQ ID NO: 1146 - DNA, 20 bp, Artificial Sequence
  Description of Artificial Sequence: Synthetic primer
cattcagctgctcctttgag

SEQ ID NO: 1147 - DNA, 20 bp, Artificial Sequence
  Description of Artificial Sequence: Synthetic primer
ggtaatcttccagaggacac

SEQ ID NO: 1148 - DNA, 20 bp, Artificial Sequence
  Description of Artificial Sequence: Synthetic primer
agtgcaagaacctgcaaagc

SEQ ID NO: 1149 - DNA, 20 bp, Artificial Sequence
  Description of Artificial Sequence: Synthetic primer
cagaagaaagacatcactgg

SEQ ID NO: 1150 - DNA, 20 bp, Artificial Sequence
  Description of Artificial Sequence: Synthetic primer
gtaaaactttgtcgtgggag

SEQ ID NO: 1151 - DNA, 20 bp, Artificial Sequence
  Description of Artificial Sequence: Synthetic primer
cttctaacccactcctgaac

SEQ ID NO: 1152 - DNA, 20 bp, Artificial Sequence
  Description of Artificial Sequence: Synthetic primer
taagccaggagtcttctagg

SEQ ID NO: 1153 - DNA, 20 bp, Artificial Sequence
  Description of Artificial Sequence: Synthetic primer
tgtgctcacaacagctttcc

SEQ ID NO: 1154 - DNA, 20 bp, Artificial Sequence
  Description of Artificial Sequence: Synthetic primer
caggttcccgatagagattc

SEQ ID NO: 1155 - DNA, 20 bp, Artificial Sequence
  Description of Artificial Sequence: Synthetic primer
tgctacagatacaggctcag

SEQ ID NO: 1156 - DNA, 20 bp, Artificial Sequence
  Description of Artificial Sequence: Synthetic primer
cagagccataatcacaactg

SEQ ID NO: 1157 - DNA, 20 bp, Artificial Sequence
  Description of Artificial Sequence: Synthetic primer
tgttcttccccttacctcag

SEQ ID NO: 1158 - DNA, 20 bp, Artificial Sequence
  Description of Artificial Sequence: Synthetic primer
gaccatgactgcttcatctc

SEQ ID NO: 1159 - DNA, 20 bp, Artificial Sequence
  Description of Artificial Sequence: Synthetic primer
ttgatgccaccaactgaagg

SEQ ID NO: 1160 - DNA, 20 bp, Artificial Sequence
  Description of Artificial Sequence: Synthetic primer
acccttacgttttcctagag

SEQ ID NO: 1161 - DNA, 19 bp, Artificial Sequence
  Description of Artificial Sequence: Synthetic primer
ttgggacagatctccatgc

SEQ ID NO: 1162 - DNA, 20 bp, Artificial Sequence
  Description of Artificial Sequence: Synthetic primer
tttcagtgtgggatcagacc

SEQ ID NO: 1163 - DNA, 21 bp, Artificial Sequence
  Description of Artificial Sequence: Synthetic primer
gctcattttagacagatggag

SEQ ID NO: 1164 - DNA, 19 bp, Artificial Sequence
  Description of Artificial Sequence: Synthetic primer
ccagaagtttgagtatcac

SEQ ID NO: 1165 - DNA, 19 bp, Artificial Sequence
  Description of Artificial Sequence: Synthetic primer
ctatttcagttctaaccct

SEQ ID NO: 1166 - DNA, 19 bp, Artificial Sequence
  Description of Artificial Sequence: Synthetic primer
gagacatatcaaggaataa

SEQ ID NO: 1167 - DNA, 20 bp, Artificial Sequence
  Description of Artificial Sequence: Synthetic primer
cctctgacaaaaagaggagc

SEQ ID NO: 1168 - DNA, 19 bp, Artificial Sequence
  Description of Artificial Sequence: Synthetic primer
caaggaatttagaaaatgc

SEQ ID NO: 1169 - DNA, 19 bp, Artificial Sequence
  Description of Artificial Sequence: Synthetic primer
tcacatttaccaactactg

SEQ ID NO: 1170 - DNA, 20 bp, Artificial Sequence
  Description of Artificial Sequence: Synthetic primer
aatgtcaggttgttgactgc

SEQ ID NO: 1171 - DNA, 20 bp, Artificial Sequence
  Description of Artificial Sequence: Synthetic primer
agatatggctgagaagtggg

SEQ ID NO: 1172 - DNA, 19 bp, Artificial Sequence
  Description of Artificial Sequence: Synthetic primer
gacaggagctctatattta

SEQ ID NO: 1173 - DNA, 19 bp, Artificial Sequence
  Description of Artificial Sequence: Synthetic primer
ctaacctgctacctacctt

SEQ ID NO: 1174 - DNA, 20 bp, Artificial Sequence
  Description of Artificial Sequence: Synthetic primer
tctctctgtaagatgtgaag

SEQ ID NO: 1175 - DNA, 20 bp, Artificial Sequence
  Description of Artificial Sequence: Synthetic primer
tcttcacatcttacagagag

SEQ ID NO: 1176 - DNA, 20 bp, Artificial Sequence
  Description of Artificial Sequence: Synthetic primer
ctactaaagctgatgctgtc

SEQ ID NO: 1177 - DNA, 20 bp, Artificial Sequence
  Description of Artificial Sequence: Synthetic primer
ctgtcagctgccatgcttag

SEQ ID NO: 1178 - DNA, 20 bp, Artificial Sequence
  Description of Artificial Sequence: Synthetic primer
cttggtaataatatatagtg

SEQ ID NO: 1179 - DNA, 20 bp, Artificial Sequence
  Description of Artificial Sequence: Synthetic primer
tgaatgtcttcagggtgagg

SEQ ID NO: 1180 - DNA, 19 bp, Artificial Sequence
  Description of Artificial Sequence: Synthetic primer
aaacaaagcctttgagacc

SEQ ID NO: 1181 - DNA, 20 bp, Artificial Sequence
  Description of Artificial Sequence: Synthetic primer
aaaacattttaatgcacttc

SEQ ID NO: 1182 - DNA, 20 bp, Artificial Sequence
  Description of Artificial Sequence: Synthetic primer
aattttcatctattctcaag

SEQ ID NO: 1183 - DNA, 21 bp, Artificial Sequence
  Description of Artificial Sequence: Synthetic primer
ccagaaggccttcaaaataag

SEQ ID NO: 1184 - DNA, 19 bp, Artificial Sequence
  Description of Artificial Sequence: Synthetic primer
gagtagcaaagcatatgaa

SEQ ID NO: 1185 - DNA, 21 bp, Artificial Sequence
  Description of Artificial Sequence: Synthetic primer
ccagaaggccttcaaaataag

SEQ ID NO: 1186 - DNA, 20 bp, Artificial Sequence
  Description of Artificial Sequence: Synthetic primer
gcaactaaaagaaacagacc

SEQ ID NO: 1187 - DNA, 19 bp, Artificial Sequence
  Description of Artificial Sequence: Synthetic primer
tcatcaaacaagatggtat

SEQ ID NO: 1188 - DNA, 20 bp, Artificial Sequence
  Description of Artificial Sequence: Synthetic primer
actgcaaactcagtaaaagg

SEQ ID NO: 1189 - DNA, 20 bp, Artificial Sequence
  Description of Artificial Sequence: Synthetic primer
ccaaagcttgagagctagag

SEQ ID NO: 1190 - DNA, 20 bp, Artificial Sequence
  Description of Artificial Sequence: Synthetic primer
tcccaaagggaattatcacc

SEQ ID NO: 1191 - DNA, 19 bp, Artificial Sequence
  Description of Artificial Sequence: Synthetic primer
ttcaatagcaagcaagttt

SEQ ID NO: 1192 - DNA, 19 bp, Artificial Sequence
  Description of Artificial Sequence: Synthetic primer
agaattcctctaatatgac

SEQ ID NO: 1193 - DNA, 20 bp, Artificial Sequence
  Description of Artificial Sequence: Synthetic primer
cttcttcaatacataagaac

SEQ ID NO: 1194 - DNA, 20 bp, Artificial Sequence
  Description of Artificial Sequence: Synthetic primer
gagcactgagccataaaagg

SEQ ID NO: 1195 - DNA, 21 bp, Artificial Sequence
  Description of Artificial Sequence: Synthetic primer
cctcatttttaggccaaaata

SEQ ID NO: 1196 - DNA, 19 bp, Artificial Sequence
  Description of Artificial Sequence: Synthetic primer
tttttcattgcatagactg

SEQ ID NO: 1197 - DNA, 19 bp, Artificial Sequence
  Description of Artificial Sequence: Synthetic primer
gttttttacaggctggtgg

SEQ ID NO: 1198 - DNA, 20 bp, Artificial Sequence
  Description of Artificial Sequence: Synthetic primer
agaaggataggatttgtgag

SEQ ID NO: 1199 - DNA, 20 bp, Artificial Sequence
  Description of Artificial Sequence: Synthetic primer
gttctacgctagaaatcaac

SEQ ID NO: 1200 - DNA, 20 bp, Artificial Sequence
  Description of Artificial Sequence: Synthetic primer
aaagaaacatgggtggtgag

SEQ ID NO: 1201 - DNA, 20 bp, Artificial Sequence
  Description of Artificial Sequence: Synthetic primer
tcaccacccatgtttctttg

SEQ ID NO: 1202 - DNA, 20 bp, Artificial Sequence
  Description of Artificial Sequence: Synthetic primer
tcacacaaagcagtagcagg

SEQ ID NO: 1203 - DNA, 20 bp, Artificial Sequence
  Description of Artificial Sequence: Synthetic primer
tcctgtacctgccttctttc

SEQ ID NO: 1204 - DNA, 20 bp, Artificial Sequence
  Description of Artificial Sequence: Synthetic primer
gggaccatggtgtggttttg

SEQ ID NO: 1205 - DNA, 21 bp, Artificial Sequence
  Description of Artificial Sequence: Synthetic primer
ctgctttgtgtgaaattctcc

SEQ ID NO: 1206 - DNA, 20 bp, Artificial Sequence
  Description of Artificial Sequence: Synthetic primer
agggtggttacaggttgatg

SEQ ID NO: 1207 - DNA, 20 bp, Artificial Sequence
  Description of Artificial Sequence: Synthetic primer
gagagtaactgaaggaggtg

SEQ ID NO: 1208 - DNA, 20 bp, Artificial Sequence
  Description of Artificial Sequence: Synthetic primer
acatcaacctgtaaccaccc

SEQ ID NO: 1209 - DNA, 20 bp, Artificial Sequence
  Description of Artificial Sequence: Synthetic primer
agaaataacatacccagggc

SEQ ID NO: 1210 - DNA, 20 bp, Artificial Sequence
  Description of Artificial Sequence: Synthetic primer
cacctccttcagttactctc

SEQ ID NO: 1211 - DNA, 20 bp, Artificial Sequence
  Description of Artificial Sequence: Synthetic primer
aggaaactggtcttcccttg

SEQ ID NO: 1212 - DNA, 20 bp, Artificial Sequence
  Description of Artificial Sequence: Synthetic primer
tatgcctagccctgggtatg

SEQ ID NO: 1213 - DNA, 20 bp, Artificial Sequence
  Description of Artificial Sequence: Synthetic primer
ttcagcaaaggagagagacc

SEQ ID NO: 1214 - DNA, 20 bp, Artificial Sequence
  Description of Artificial Sequence: Synthetic primer
gtgttaaacggggtttgagc

SEQ ID NO: 1215 - DNA, 20 bp, Artificial Sequence
  Description of Artificial Sequence: Synthetic primer
tcagcaggaacaagtctagg

SEQ ID NO: 1216 - DNA, 20 bp, Artificial Sequence
  Description of Artificial Sequence: Synthetic primer
gaatgttggccaagtggcag

SEQ ID NO: 1217 - DNA, 20 bp, Artificial Sequence
  Description of Artificial Sequence: Synthetic primer
ctccagtgacagatgcaaac

SEQ ID NO: 1218 - DNA, 20 bp, Artificial Sequence
  Description of Artificial Sequence: Synthetic primer
tgaggaccctttgtgagcag

SEQ ID NO: 1219 - DNA, 20 bp, Artificial Sequence
  Description of Artificial Sequence: Synthetic primer
tctcctgcagggccctgcct

SEQ ID NO: 1220 - DNA, 20 bp, Artificial Sequence
  Description of Artificial Sequence: Synthetic primer
atggtgtgtggcagtgtgag

SEQ ID NO: 1221 - DNA, 20 bp, Artificial Sequence
  Description of Artificial Sequence: Synthetic primer
cctccacacagtggttcttc

SEQ ID NO: 1222 - DNA, 20 bp, Artificial Sequence
  Description of Artificial Sequence: Synthetic primer
atccttcacctcctttgcac

SEQ ID NO: 1223 - DNA, 20 bp, Artificial Sequence
  Description of Artificial Sequence: Synthetic primer
agtgagaaggttgtcaccag

SEQ ID NO: 1224 - DNA, 19 bp, Artificial Sequence
  Description of Artificial Sequence: Synthetic primer
ggtcccaggccagagggtt

SEQ ID NO: 1225 - DNA, 20 bp, Artificial Sequence
  Description of Artificial Sequence: Synthetic primer
tgttcctggcccgacagcct

SEQ ID NO: 1226 - DNA, 19 bp, Artificial Sequence
  Description of Artificial Sequence: Synthetic primer
gggcagatgtttcctctga

SEQ ID NO: 1227 - DNA, 20 bp, Artificial Sequence
  Description of Artificial Sequence: Synthetic primer
gtggttagtttgctggtgac

SEQ ID NO: 1228 - DNA, 20 bp, Artificial Sequence
  Description of Artificial Sequence: Synthetic primer
gctcttccaccggtttttac

SEQ ID NO: 1229 - DNA, 19 bp, Artificial Sequence
  Description of Artificial Sequence: Synthetic primer
ctctggcgagccctcttac

SEQ ID NO: 1230 - DNA, 19 bp, Artificial Sequence
  Description of Artificial Sequence: Synthetic primer
tgtaggagccgaggtggag

SEQ ID NO: 1231 - DNA, 20 bp, Artificial Sequence
  Description of Artificial Sequence: Synthetic primer
ttggtgccatttgggagaac

SEQ ID NO: 1232 - DNA, 20 bp, Artificial Sequence
  Description of Artificial Sequence: Synthetic primer
acaaaacaaatcttatagac

SEQ ID NO: 1233 - DNA, 20 bp, Artificial Sequence
  Description of Artificial Sequence: Synthetic primer
acaaaacaaatcttatagac

SEQ ID NO: 1234 - DNA, 20 bp, Artificial Sequence
  Description of Artificial Sequence: Synthetic primer
tttaatgtttaaaccttgtg

SEQ ID NO: 1235 - DNA, 20 bp, Artificial Sequence
  Description of Artificial Sequence: Synthetic primer
taaccttccaaagaagtgcc

SEQ ID NO: 1236 - DNA, 20 bp, Artificial Sequence
  Description of Artificial Sequence: Synthetic primer
tcaccacctggaagtgagtc

SEQ ID NO: 1237 - DNA, 20 bp, Artificial Sequence
  Description of Artificial Sequence: Synthetic primer
tcaaaatagggcttcagcag

SEQ ID NO: 1238 - DNA, 19 bp, Artificial Sequence
  Description of Artificial Sequence: Synthetic primer
acttccaggtggtgaggac

SEQ ID NO: 1239 - DNA, 19 bp, Artificial Sequence
  Description of Artificial Sequence: Synthetic primer
tggccctgcctgttgcctt

SEQ ID NO: 1240 - DNA, 20 bp, Artificial Sequence
  Description of Artificial Sequence: Synthetic primer
tacctggagacagaaacagc

SEQ ID NO: 1241 - DNA, 20 bp, Artificial Sequence
  Description of Artificial Sequence: Synthetic primer
catggaccttccagcttatg

SEQ ID NO: 1242 - DNA, 20 bp, Artificial Sequence
  Description of Artificial Sequence: Synthetic primer
gccaacaattatgaaggcag

SEQ ID NO: 1243 - DNA, 20 bp, Artificial Sequence
  Description of Artificial Sequence: Synthetic primer
ttgggcgctttttcccaagg

SEQ ID NO: 1244 - DNA, 20 bp, Artificial Sequence
  Description of Artificial Sequence: Synthetic primer
atcaggcagctggtggtcct

SEQ ID NO: 1245 - DNA, 20 bp, Artificial Sequence
  Description of Artificial Sequence: Synthetic primer
tggtccctgctgcactcact

SEQ ID NO: 1246 - DNA, 20 bp, Artificial Sequence
  Description of Artificial Sequence: Synthetic primer
tcaggtatggttttgctggg

SEQ ID NO: 1247 - DNA, 20 bp, Artificial Sequence
  Description of Artificial Sequence: Synthetic primer
gtttgaacccactcttcctg

SEQ ID NO: 1248 - DNA, 20 bp, Artificial Sequence
  Description of Artificial Sequence: Synthetic primer
ctgtagctatttctggaccc

SEQ ID NO: 1249 - DNA, 19 bp, Artificial Sequence
  Description of Artificial Sequence: Synthetic primer
aagtagcaaaatcagcttc

SEQ ID NO: 1250 - DNA, 20 bp, Artificial Sequence
  Description of Artificial Sequence: Synthetic primer
gagatttgcttgccaatagg

SEQ ID NO: 1251 - DNA, 20 bp, Artificial Sequence
  Description of Artificial Sequence: Synthetic primer
ctgtctctcaccccttcatt

SEQ ID NO: 1252 - DNA, 20 bp, Artificial Sequence
  Description of Artificial Sequence: Synthetic primer
gatttgcttgccaataggag

SEQ ID NO: 1253 - DNA, 20 bp, Artificial Sequence
  Description of Artificial Sequence: Synthetic primer
ccaatgaatgtcctcatcag

SEQ ID NO: 1254 - DNA, 20 bp, Artificial Sequence
  Description of Artificial Sequence: Synthetic primer
ccttgagaaactaagtgacc

SEQ ID NO: 1255 - DNA, 20 bp, Artificial Sequence
  Description of Artificial Sequence: Synthetic primer
gctgtctaatagaagcttac

SEQ ID NO: 1256 - DNA, 20 bp, Artificial Sequence
  Description of Artificial Sequence: Synthetic primer
cactcaagtttccctcttgc

SEQ ID NO: 1257 - DNA, 20 bp, Artificial Sequence
  Description of Artificial Sequence: Synthetic primer
tccaagtcctcttaaaggag

SEQ ID NO: 1258 - DNA, 20 bp, Artificial Sequence
  Description of Artificial Sequence: Synthetic primer
gggccagtaccatttcatag

SEQ ID NO: 1259 - DNA, 21 bp, Artificial Sequence
  Description of Artificial Sequence: Synthetic primer
gcaaggttgaaattgggaatg

SEQ ID NO: 1260 - DNA, 20 bp, Artificial Sequence
  Description of Artificial Sequence: Synthetic primer
ttcagcaaggttgaaattgg

SEQ ID NO: 1261 - DNA, 21 bp, Artificial Sequence
  Description of Artificial Sequence: Synthetic primer
cattcccaatttcaaccttgc

SEQ ID NO: 1262 - DNA, 20 bp, Artificial Sequence
  Description of Artificial Sequence: Synthetic primer
tgccagccttatcctgtatc

SEQ ID NO: 1263 - DNA, 20 bp, Artificial Sequence
  Description of Artificial Sequence: Synthetic primer
gctagctattccagtttgaa

SEQ ID NO: 1264 - DNA, 19 bp, Artificial Sequence
  Description of Artificial Sequence: Synthetic primer
tgagggaacaaaatcttac

SEQ ID NO: 1265 - DNA, 19 bp, Artificial Sequence
  Description of Artificial Sequence: Synthetic primer
tgagggaacaaaatcttac

SEQ ID NO: 1266 - DNA, 20 bp, Artificial Sequence
  Description of Artificial Sequence: Synthetic primer
cttcatgctggagtaatggg

SEQ ID NO: 1267 - DNA, 20 bp, Artificial Sequence
  Description of Artificial Sequence: Synthetic primer
cccattactccagcatgaag

SEQ ID NO: 1268 - DNA, 19 bp, Artificial Sequence
  Description of Artificial Sequence: Synthetic primer
ttttaccattagtggtttg

SEQ ID NO: 1269 - DNA, 19 bp, Artificial Sequence
  Description of Artificial Sequence: Synthetic primer
ttttaccattagtggtttg

SEQ ID NO: 1270 - DNA, 20 bp, Artificial Sequence
  Description of Artificial Sequence: Synthetic primer
atccaagatactcactttcc

SEQ ID NO: 1271 - DNA, 20 bp, Artificial Sequence
  Description of Artificial Sequence: Synthetic primer
ctccctccccagtagaaata

SEQ ID NO: 1272 - DNA, 20 bp, Artificial Sequence
  Description of Artificial Sequence: Synthetic primer
catttcaaaatctctggccc

SEQ ID NO: 1273 - DNA, 19 bp, Artificial Sequence
  Description of Artificial Sequence: Synthetic primer
tatctggtaagaaattgtg

SEQ ID NO: 1274 - DNA, 19 bp, Artificial Sequence
  Description of Artificial Sequence: Synthetic primer
gtactcaaatcaaattggc

SEQ ID NO: 1275 - DNA, 20 bp, Artificial Sequence
  Description of Artificial Sequence: Synthetic primer
gaggcaactaggacttaagg

SEQ ID NO: 1276 - DNA, 20 bp, Artificial Sequence
  Description of Artificial Sequence: Synthetic primer
ccagccaagaatacaaacac

SEQ ID NO: 1277 - DNA, 20 bp, Artificial Sequence
  Description of Artificial Sequence: Synthetic primer
ggtgaaggctgtatttgtag

SEQ ID NO: 1278 - DNA, 20 bp, Artificial Sequence
  Description of Artificial Sequence: Synthetic primer
gtaggtgaaggctgtatttg

SEQ ID NO: 1279 - DNA, 20 bp, Artificial Sequence
  Description of Artificial Sequence: Synthetic primer
cattggccttaactccagag

SEQ ID NO: 1280 - DNA, 21 bp, Artificial Sequence
  Description of Artificial Sequence: Synthetic primer
gctattaagaagtttgctgag

SEQ ID NO: 1281 - DNA, 20 bp, Artificial Sequence
  Description of Artificial Sequence: Synthetic primer
gctctacagacaatctgatg

SEQ ID NO: 1282 - DNA, 20 bp, Artificial Sequence
  Description of Artificial Sequence: Synthetic primer
aatgaagagccatgtctgcc

SEQ ID NO: 1283 - DNA, 21 bp, Artificial Sequence
  Description of Artificial Sequence: Synthetic primer
caccagtatcagcaatagctt

SEQ ID NO: 1284 - DNA, 20 bp, Artificial Sequence
  Description of Artificial Sequence: Synthetic primer
gaagtctcatctctacttcg

SEQ ID NO: 1285 - DNA, 20 bp, Artificial Sequence
  Description of Artificial Sequence: Synthetic primer
gtacgaagtagagatgagac

SEQ ID NO: 1286 - DNA, 20 bp, Artificial Sequence
  Description of Artificial Sequence: Synthetic primer
gtacgaagtagagatgagac

SEQ ID NO: 1287 - DNA, 18 bp, Artificial Sequence
  Description of Artificial Sequence: Synthetic primer
aggtcatagaaggttatg

SEQ ID NO: 1288 - DNA, 21 bp, Artificial Sequence
  Description of Artificial Sequence: Synthetic primer
cattacccccttattattttg

SEQ ID NO: 1289 - DNA, 20 bp, Artificial Sequence
  Description of Artificial Sequence: Synthetic primer
cattcatcagaatgtgaccc

SEQ ID NO: 1290 - DNA, 20 bp, Artificial Sequence
  Description of Artificial Sequence: Synthetic primer
gctaaagctccttcttctac

SEQ ID NO: 1291 - DNA, 20 bp, Artificial Sequence
  Description of Artificial Sequence: Synthetic primer
ggatgggagatctgctaaac

SEQ ID NO: 1292 - DNA, 20 bp, Artificial Sequence
  Description of Artificial Sequence: Synthetic primer
ctgtggtaagaagacgaagc

SEQ ID NO: 1293 - DNA, 19 bp, Artificial Sequence
  Description of Artificial Sequence: Synthetic primer
gataaggctcaattacttg

SEQ ID NO: 1294 - DNA, 20 bp, Artificial Sequence
  Description of Artificial Sequence: Synthetic primer
tatagtaggtggaggtgcag

SEQ ID NO: 1295 - DNA, 20 bp, Artificial Sequence
  Description of Artificial Sequence: Synthetic primer
aaacctaaagcctgcacctc

SEQ ID NO: 1296 - DNA, 20 bp, Artificial Sequence
  Description of Artificial Sequence: Synthetic primer
gagatccagatgatacaggg

SEQ ID NO: 1297 - DNA, 20 bp, Artificial Sequence
  Description of Artificial Sequence: Synthetic primer
gaattccctgtatcatctgg

SEQ ID NO: 1298 - DNA, 21 bp, Artificial Sequence
  Description of Artificial Sequence: Synthetic primer
cctgagctctatttaacatgc

SEQ ID NO: 1299 - DNA, 20 bp, Artificial Sequence
  Description of Artificial Sequence: Synthetic primer
tacagcaatgagtgaacggg

SEQ ID NO: 1300 - DNA, 20 bp, Artificial Sequence
  Description of Artificial Sequence: Synthetic primer
aggcaaacatcctgtgtctg

SEQ ID NO: 1301 - DNA, 20 bp, Artificial Sequence
  Description of Artificial Sequence: Synthetic primer
tcagggccactatcatggac

SEQ ID NO: 1302 - DNA, 20 bp, Artificial Sequence
  Description of Artificial Sequence: Synthetic primer
caatgggccttgtaccaaag

SEQ ID NO: 1303 - DNA, 19 bp, Artificial Sequence
  Description of Artificial Sequence: Synthetic primer
ggcaatttaagacattgtg

SEQ ID NO: 1304 - DNA, 20 bp, Artificial Sequence
  Description of Artificial Sequence: Synthetic primer
aaccatacagggttttggta

SEQ ID NO: 1305 - DNA, 19 bp, Artificial Sequence
  Description of Artificial Sequence: Synthetic primer
ttaacattccacactgaag

SEQ ID NO: 1306 - DNA, 20 bp, Artificial Sequence
  Description of Artificial Sequence: Synthetic primer
cacagcccttcactgattac

SEQ ID NO: 1307 - DNA, 20 bp, Artificial Sequence
  Description of Artificial Sequence: Synthetic primer
gatcacctcaataacactgg

SEQ ID NO: 1308 - DNA, 20 bp, Artificial Sequence
  Description of Artificial Sequence: Synthetic primer
gtaatcagtgaagggctgtg

SEQ ID NO: 1309 - DNA, 20 bp, Artificial Sequence
  Description of Artificial Sequence: Synthetic primer
tgggttctgctggacagata

SEQ ID NO: 1310 - DNA, 20 bp, Artificial Sequence
  Description of Artificial Sequence: Synthetic primer
cctctacaaaattttgaggg

SEQ ID NO: 1311 - DNA, 20 bp, Artificial Sequence
  Description of Artificial Sequence: Synthetic primer
gggtcataagaagggagtaa

SEQ ID NO: 1312 - DNA, 20 bp, Artificial Sequence
  Description of Artificial Sequence: Synthetic primer
tgaatttcagctacacctag

SEQ ID NO: 1313 - DNA, 19 bp, Artificial Sequence
  Description of Artificial Sequence: Synthetic primer
taccactgtaatacacatg

SEQ ID NO: 1314 - DNA, 19 bp, Artificial Sequence
  Description of Artificial Sequence: Synthetic primer
ttcatgtgtattacagtgg

SEQ ID NO: 1315 - DNA, 20 bp, Artificial Sequence
  Description of Artificial Sequence: Synthetic primer
actgctcactgacagcttct

SEQ ID NO: 1316 - DNA, 19 bp, Artificial Sequence
  Description of Artificial Sequence: Synthetic primer
cagaacataggtttgaagc

SEQ ID NO: 1317 - DNA, 20 bp, Artificial Sequence
  Description of Artificial Sequence: Synthetic primer
gaggctcagtagaggtttag

SEQ ID NO: 1318 - DNA, 20 bp, Artificial Sequence
  Description of Artificial Sequence: Synthetic primer
tgccagactggtttgttagc

SEQ ID NO: 1319 - DNA, 20 bp, Artificial Sequence
  Description of Artificial Sequence: Synthetic primer
gtgtctcatagtcactggtc

SEQ ID NO: 1320 - DNA, 20 bp, Artificial Sequence
  Description of Artificial Sequence: Synthetic primer
ccattcttgcaacagttccc

SEQ ID NO: 1321 - DNA, 18 bp, Artificial Sequence
  Description of Artificial Sequence: Synthetic primer
gggaaaaaaagtgcacct

SEQ ID NO: 1322 - DNA, 21 bp, Artificial Sequence
  Description of Artificial Sequence: Synthetic primer
cataggtgagaaaagtttggg

SEQ ID NO: 1323 - DNA, 20 bp, Artificial Sequence
  Description of Artificial Sequence: Synthetic primer
ttccccaaacttttctcacc

SEQ ID NO: 1324 - DNA, 20 bp, Artificial Sequence
  Description of Artificial Sequence: Synthetic primer
ccctacactccttcttcttt

SEQ ID NO: 1325 - DNA, 20 bp, Artificial Sequence
  Description of Artificial Sequence: Synthetic primer
aaagaagaaggagtgtaggg

SEQ ID NO: 1326 - DNA, 20 bp, Artificial Sequence
  Description of Artificial Sequence: Synthetic primer
ctcactgtacatccatcctc

SEQ ID NO: 1327 - DNA, 20 bp, Artificial Sequence
  Description of Artificial Sequence: Synthetic primer
tagtgaggggctttttccac

SEQ ID NO: 1328 - DNA, 20 bp, Artificial Sequence
  Description of Artificial Sequence: Synthetic primer
accccatgtaaaccttgagc

SEQ ID NO: 1329 - DNA, 20 bp, Artificial Sequence
  Description of Artificial Sequence: Synthetic primer
ttatcacgtgacttcagtgg

SEQ ID NO: 1330 - DNA, 20 bp, Artificial Sequence
  Description of Artificial Sequence: Synthetic primer
gtggaattctccttggactc

SEQ ID NO: 1331 - DNA, 20 bp, Artificial Sequence
  Description of Artificial Sequence: Synthetic primer
atactcttatccagttcagc

SEQ ID NO: 1332 - DNA, 20 bp, Artificial Sequence
  Description of Artificial Sequence: Synthetic primer
ggaggagatatggtgcagag

SEQ ID NO: 1333 - DNA, 20 bp, Artificial Sequence
  Description of Artificial Sequence: Synthetic primer
ctcttcaaatgcacctagtg

SEQ ID NO: 1334 - DNA, 20 bp, Artificial Sequence
  Description of Artificial Sequence: Synthetic primer
ggaaagggaaaaaaacctgc

SEQ ID NO: 1335 - DNA, 19 bp, Artificial Sequence
  Description of Artificial Sequence: Synthetic primer
tccagaaggaggccctggt

SEQ ID NO: 1336 - DNA, 20 bp, Artificial Sequence
  Description of Artificial Sequence: Synthetic primer
ttttaatcagaatcatagag

SEQ ID NO: 1337 - DNA, 20 bp, Artificial Sequence
  Description of Artificial Sequence: Synthetic primer
gaaactctagaaaaacccag

SEQ ID NO: 1338 - DNA, 20 bp, Artificial Sequence
  Description of Artificial Sequence: Synthetic primer
acaagtctgagagcctaaag

SEQ ID NO: 1339 - DNA, 19 bp, Artificial Sequence
  Description of Artificial Sequence: Synthetic primer
gagtgtgtcacttaaggtc

SEQ ID NO: 1340 - DNA, 20 bp, Artificial Sequence
  Description of Artificial Sequence: Synthetic primer
atagcactaacagctcaagg

SEQ ID NO: 1341 - DNA, 20 bp, Artificial Sequence
  Description of Artificial Sequence: Synthetic primer
gccattacctgcaaccatgt

SEQ ID NO: 1342 - DNA, 20 bp, Artificial Sequence
  Description of Artificial Sequence: Synthetic primer
aacatggttgcaggtaatgg

SEQ ID NO: 1343 - DNA, 21 bp, Artificial Sequence
  Description of Artificial Sequence: Synthetic primer
atttgtacagtttcccattcc

SEQ ID NO: 1344 - DNA, 20 bp, Artificial Sequence
  Description of Artificial Sequence: Synthetic primer
tatggtgctaaaaaggactg

SEQ ID NO: 1345 - DNA, 20 bp, Artificial Sequence
  Description of Artificial Sequence: Synthetic primer
agtggcagaagatggaatag

SEQ ID NO: 1346 - DNA, 19 bp, Artificial Sequence
  Description of Artificial Sequence: Synthetic primer
tttattaaatcagtctggg

SEQ ID NO: 1347 - DNA, 21 bp, Artificial Sequence
  Description of Artificial Sequence: Synthetic primer
gtataacattatacagagagg

SEQ ID NO: 1348 - DNA, 20 bp, Artificial Sequence
  Description of Artificial Sequence: Synthetic primer
actgctgccctttctatatg

SEQ ID NO: 1349 - DNA, 20 bp, Artificial Sequence
  Description of Artificial Sequence: Synthetic primer
tcaaatgtgaggaaagtgcc

SEQ ID NO: 1350 - DNA, 20 bp, Artificial Sequence
  Description of Artificial Sequence: Synthetic primer
gtgccagaacattctgaatc

SEQ ID NO: 1351 - DNA, 19 bp, Artificial Sequence
  Description of Artificial Sequence: Synthetic primer
ggaaaagattatgatgcac

SEQ ID NO: 1352 - DNA, 20 bp, Artificial Sequence
  Description of Artificial Sequence: Synthetic primer
gaaaaaagtgcatgtctttg

SEQ ID NO: 1353 - DNA, 20 bp, Artificial Sequence
  Description of Artificial Sequence: Synthetic primer
gattatgatgcactggcctg

SEQ ID NO: 1354 - DNA, 20 bp, Artificial Sequence
  Description of Artificial Sequence: Synthetic primer
attatgaaaaaagtgcatgt

SEQ ID NO: 1355 - DNA, 19 bp, Artificial Sequence
  Description of Artificial Sequence: Synthetic primer
cttaaaattagggatcaga

SEQ ID NO: 1356 - DNA, 21 bp, Artificial Sequence
  Description of Artificial Sequence: Synthetic primer
ctgaagaagtgtaaaaatggc

SEQ ID NO: 1357 - DNA, 20 bp, Artificial Sequence
  Description of Artificial Sequence: Synthetic primer
ttgtccttaggcacaaatgg

SEQ ID NO: 1358 - DNA, 21 bp, Artificial Sequence
  Description of Artificial Sequence: Synthetic primer
gtgcctaaggacaactttttc

SEQ ID NO: 1359 - DNA, 19 bp, Artificial Sequence
  Description of Artificial Sequence: Synthetic primer
aaacaatgggttctagaaa

SEQ ID NO: 1360 - DNA, 20 bp, Artificial Sequence
  Description of Artificial Sequence: Synthetic primer
cccagatgaaggggttttag

SEQ ID NO: 1361 - DNA, 20 bp, Artificial Sequence
  Description of Artificial Sequence: Synthetic primer
actaaaaccccttcatctgg

SEQ ID NO: 1362 - DNA, 20 bp, Artificial Sequence
  Description of Artificial Sequence: Synthetic primer
ctgctaactcagatacctgc

SEQ ID NO: 1363 - DNA, 18 bp, Artificial Sequence
  Description of Artificial Sequence: Synthetic primer
cttctatcagcaagttag

SEQ ID NO: 1364 - DNA, 20 bp, Artificial Sequence
  Description of Artificial Sequence: Synthetic primer
gtctcacatcccatttacag

SEQ ID NO: 1365 - DNA, 21 bp, Artificial Sequence
  Description of Artificial Sequence: Synthetic primer
ctagcaaagaataatcatatc

SEQ ID NO: 1366 - DNA, 20 bp, Artificial Sequence
  Description of Artificial Sequence: Synthetic primer
ccatgctgaatttgaactgg

SEQ ID NO: 1367 - DNA, 19 bp, Artificial Sequence
  Description of Artificial Sequence: Synthetic primer
aatactgataatttgcagc

SEQ ID NO: 1368 - DNA, 19 bp, Artificial Sequence
  Description of Artificial Sequence: Synthetic primer
cccataggacacctatgac

SEQ ID NO: 1369 - DNA, 20 bp, Artificial Sequence
  Description of Artificial Sequence: Synthetic primer
aatgaatctgccagatctgt

SEQ ID NO: 1370 - DNA, 19 bp, Artificial Sequence
  Description of Artificial Sequence: Synthetic primer
tctgatttatactgaggac

SEQ ID NO: 1371 - DNA, 20 bp, Artificial Sequence
  Description of Artificial Sequence: Synthetic primer
ggcaatgagttccataagtt

SEQ ID NO: 1372 - DNA, 20 bp, Artificial Sequence
  Description of Artificial Sequence: Synthetic primer
acaaacgctgcaccttgcac

SEQ ID NO: 1373 - DNA, 20 bp, Artificial Sequence
  Description of Artificial Sequence: Synthetic primer
ggagctgagaatgacagttg

SEQ ID NO: 1374 - DNA, 19 bp, Artificial Sequence
  Description of Artificial Sequence: Synthetic primer
aagaccaagattcagaagc

SEQ ID NO: 1375 - DNA, 20 bp, Artificial Sequence
  Description of Artificial Sequence: Synthetic primer
gaaatgaagtgcaggaaagc

SEQ ID NO: 1376 - DNA, 20 bp, Artificial Sequence
  Description of Artificial Sequence: Synthetic primer
caatcaccacaaactccggc

SEQ ID NO: 1377 - DNA, 19 bp, Artificial Sequence
  Description of Artificial Sequence: Synthetic primer
cagcatcgctgccttcttg

SEQ ID NO: 1378 - DNA, 19 bp, Artificial Sequence
  Description of Artificial Sequence: Synthetic primer
aagaaggcagcgatgctgg

SEQ ID NO: 1379 - DNA, 20 bp, Artificial Sequence
  Description of Artificial Sequence: Synthetic primer
tccatctgcccatcccatct

SEQ ID NO: 1380 - DNA, 20 bp, Artificial Sequence
  Description of Artificial Sequence: Synthetic primer
cagcccttctctgtcagttt

SEQ ID NO: 1381 - DNA, 20 bp, Artificial Sequence
  Description of Artificial Sequence: Synthetic primer
cccgatgggaactctcattt

SEQ ID NO: 1382 - DNA, 20 bp, Artificial Sequence
  Description of Artificial Sequence: Synthetic primer
tctgaacccttagttaggac

SEQ ID NO: 1383 - DNA, 20 bp, Artificial Sequence
  Description of Artificial Sequence: Synthetic primer
acttcaccggatgatctggg

SEQ ID NO: 1384 - DNA, 20 bp, Artificial Sequence
  Description of Artificial Sequence: Synthetic primer
atccagccatccacgctcag

SEQ ID NO: 1385 - DNA, 20 bp, Artificial Sequence
  Description of Artificial Sequence: Synthetic primer
aaaagtcctcaggacctgcc

SEQ ID NO: 1386 - DNA, 20 bp, Artificial Sequence
  Description of Artificial Sequence: Synthetic primer
caaaacgccctgtgagctct

SEQ ID NO: 1387 - DNA, 20 bp, Artificial Sequence
  Description of Artificial Sequence: Synthetic primer
atgaaagtggccccctgctc

SEQ ID NO: 1388 - DNA, 19 bp, Artificial Sequence
  Description of Artificial Sequence: Synthetic primer
tcctcagactctccccttg

SEQ ID NO: 1389 - DNA, 19 bp, Artificial Sequence
  Description of Artificial Sequence: Synthetic primer
aagggaggctgcccaggac

SEQ ID NO: 1390 - DNA, 20 bp, Artificial Sequence
  Description of Artificial Sequence: Synthetic primer
ccattgaagcattcagcagg

SEQ ID NO: 1391 - DNA, 20 bp, Artificial Sequence
  Description of Artificial Sequence: Synthetic primer
ggatgagcagctcgcaatag

SEQ ID NO: 1392 - DNA, 20 bp, Artificial Sequence
  Description of Artificial Sequence: Synthetic primer
agtgtctgcagttttctggg

SEQ ID NO: 1393 - DNA, 20 bp, Artificial Sequence
  Description of Artificial Sequence: Synthetic primer
tgacccagattcctgaagag

SEQ ID NO: 1394 - DNA, 20 bp, Artificial Sequence
  Description of Artificial Sequence: Synthetic primer
tgacccagattcctgaagag

SEQ ID NO: 1395 - DNA, 19 bp, Artificial Sequence
  Description of Artificial Sequence: Synthetic primer
ggaagagcgtggagcaaga

SEQ ID NO: 1396 - DNA, 20 bp, Artificial Sequence
  Description of Artificial Sequence: Synthetic primer
gtctcaatcttgttggccag

SEQ ID NO: 1397 - DNA, 19 bp, Artificial Sequence
  Description of Artificial Sequence: Synthetic primer
tgggtgttctgcaggctgg

SEQ ID NO: 1398 - DNA, 18 bp, Artificial Sequence
  Description of Artificial Sequence: Synthetic primer
ccacccccaccccgtcac

SEQ ID NO: 1399 - DNA, 20 bp, Artificial Sequence
  Description of Artificial Sequence: Synthetic primer
agacactgacccccagagac

SEQ ID NO: 1400 - DNA, 19 bp, Artificial Sequence
  Description of Artificial Sequence: Synthetic primer
tacaccagccccacatgag

SEQ ID NO: 1401 - DNA, 20 bp, Artificial Sequence
  Description of Artificial Sequence: Synthetic primer
tcctccaggactggccaagt

SEQ ID NO: 1402 - DNA, 20 bp, Artificial Sequence
  Description of Artificial Sequence: Synthetic primer
caaacattattttgattggc

SEQ ID NO: 1403 - DNA, 20 bp, Artificial Sequence
  Description of Artificial Sequence: Synthetic primer
ggtgttaacatttagaacag

SEQ ID NO: 1404 - DNA, 20 bp, Artificial Sequence
  Description of Artificial Sequence: Synthetic primer
gctggcatatgctgtcagga

SEQ ID NO: 1405 - DNA, 20 bp, Artificial Sequence
  Description of Artificial Sequence: Synthetic primer
tatctgtttcgtttctaggg

SEQ ID NO: 1406 - DNA, 20 bp, Artificial Sequence
  Description of Artificial Sequence: Synthetic primer
tcctattgcattgagcatgg

SEQ ID NO: 1407 - DNA, 20 bp, Artificial Sequence
  Description of Artificial Sequence: Synthetic primer
tgctgttcaaaaactggccc

SEQ ID NO: 1408 - DNA, 20 bp, Artificial Sequence
  Description of Artificial Sequence: Synthetic primer
caatcattgctacccttcgg

SEQ ID NO: 1409 - DNA, 19 bp, Artificial Sequence
  Description of Artificial Sequence: Synthetic primer
gggtgtacagtgaagagac

SEQ ID NO: 1410 - DNA, 20 bp, Artificial Sequence
  Description of Artificial Sequence: Synthetic primer
tcgggccagtttttgaacag

SEQ ID NO: 1411 - DNA, 20 bp, Artificial Sequence
  Description of Artificial Sequence: Synthetic primer
gtctcttcactgtacacccc

SEQ ID NO: 1412 - DNA, 20 bp, Artificial Sequence
  Description of Artificial Sequence: Synthetic primer
cagcatgaagacctcatctg

SEQ ID NO: 1413 - DNA, 20 bp, Artificial Sequence
  Description of Artificial Sequence: Synthetic primer
tgcagttgctgaagaggaag

SEQ ID NO: 1414 - DNA, 20 bp, Artificial Sequence
  Description of Artificial Sequence: Synthetic primer
ctctctactgatgatctgaa

SEQ ID NO: 1415 - DNA, 20 bp, Artificial Sequence
  Description of Artificial Sequence: Synthetic primer
aagaggttgctggggccaag

SEQ ID NO: 1416 - DNA, 19 bp, Artificial Sequence
  Description of Artificial Sequence: Synthetic primer
gaagatgctctgaggcaaa

SEQ ID NO: 1417 - DNA, 20 bp, Artificial Sequence
  Description of Artificial Sequence: Synthetic primer
ggtccactaaaaatctctag

SEQ ID NO: 1418 - DNA, 19 bp, Artificial Sequence
  Description of Artificial Sequence: Synthetic primer
ttctttggcaatggaacat

SEQ ID NO: 1419 - DNA, 20 bp, Artificial Sequence
  Description of Artificial Sequence: Synthetic primer
gaaaaccataccttactcag

SEQ ID NO: 1420 - DNA, 20 bp, Artificial Sequence
  Description of Artificial Sequence: Synthetic primer
actggtcttttacctagatg

SEQ ID NO: 1421 - DNA, 20 bp, Artificial Sequence
  Description of Artificial Sequence: Synthetic primer
ttatgccacttgagtgggag

SEQ ID NO: 1422 - DNA, 20 bp, Artificial Sequence
  Description of Artificial Sequence: Synthetic primer
aatcttgaaccagtggttct

SEQ ID NO: 1423 - DNA, 20 bp, Artificial Sequence
  Description of Artificial Sequence: Synthetic primer
aggtgcaactccaaaaaagc

SEQ ID NO: 1424 - DNA, 21 bp, Artificial Sequence
  Description of Artificial Sequence: Synthetic primer
ggaatgacaaattgccaaatc

SEQ ID NO: 1425 - DNA, 20 bp, Artificial Sequence
  Description of Artificial Sequence: Synthetic primer
tccttcttataacagtgggc

SEQ ID NO: 1426 - DNA, 19 bp, Artificial Sequence
  Description of Artificial Sequence: Synthetic primer
gcagggactccccaagtgt

SEQ ID NO: 1427 - DNA, 20 bp, Artificial Sequence
  Description of Artificial Sequence: Synthetic primer
tgctgggctgccctccctgt

SEQ ID NO: 1428 - DNA, 18 bp, Artificial Sequence
  Description of Artificial Sequence: Synthetic primer
ggaaggaatcattctgag

SEQ ID NO: 1429 - DNA, 20 bp, Artificial Sequence
  Description of Artificial Sequence: Synthetic primer
ttaaagggctagacaatggg

SEQ ID NO: 1430 - DNA, 20 bp, Artificial Sequence
  Description of Artificial Sequence: Synthetic primer
tccctaccccattgtctagc

SEQ ID NO: 1431 - DNA, 20 bp, Artificial Sequence
  Description of Artificial Sequence: Synthetic primer
caattagaaatctagtgcaa

SEQ ID NO: 1432 - DNA, 21 bp, Artificial Sequence
  Description of Artificial Sequence: Synthetic primer
tatataatacttagttttggt

SEQ ID NO: 1433 - DNA, 21 bp, Artificial Sequence
  Description of Artificial Sequence: Synthetic primer
cttcttttggatcttcacctg

SEQ ID NO: 1434 - DNA, 20 bp, Artificial Sequence
  Description of Artificial Sequence: Synthetic primer
gattaaagtgcagaaaagtg

SEQ ID NO: 1435 - DNA, 18 bp, Artificial Sequence
  Description of Artificial Sequence: Synthetic primer
ggtaatttttcccttggg

SEQ ID NO: 1436 - DNA, 20 bp, Artificial Sequence
  Description of Artificial Sequence: Synthetic primer
cccaagcttaaaatgtgggc

SEQ ID NO: 1437 - DNA, 20 bp, Artificial Sequence
  Description of Artificial Sequence: Synthetic primer
cccaagcttaaaatgtgggc

SEQ ID NO: 1438 - DNA, 20 bp, Artificial Sequence
  Description of Artificial Sequence: Synthetic primer
gtgtccagtagaaggaaaac

SEQ ID NO: 1439 - DNA, 21 bp, Artificial Sequence
  Description of Artificial Sequence: Synthetic primer
gagaaaagatattcatgagac

SEQ ID NO: 1440 - DNA, 20 bp, Artificial Sequence
  Description of Artificial Sequence: Synthetic primer
gaggttcaattttatttcat

SEQ ID NO: 1441 - DNA, 19 bp, Artificial Sequence
  Description of Artificial Sequence: Synthetic primer
tcaatatcttacagtacag

SEQ ID NO: 1442 - DNA, 20 bp, Artificial Sequence
  Description of Artificial Sequence: Synthetic primer
tagaaagaaactcctcctcc

SEQ ID NO: 1443 - DNA, 20 bp, Artificial Sequence
  Description of Artificial Sequence: Synthetic primer
ttcctttatgggaggaggag

SEQ ID NO: 1444 - DNA, 20 bp, Artificial Sequence
  Description of Artificial Sequence: Synthetic primer
actacctgttccagtccttc

SEQ ID NO: 1445 - DNA, 19 bp, Artificial Sequence
  Description of Artificial Sequence: Synthetic primer
ggcacactgcaaccacagc

SEQ ID NO: 1446 - DNA, 20 bp, Artificial Sequence
  Description of Artificial Sequence: Synthetic primer
gagctgatggtgatccagac

SEQ ID NO: 1447 - DNA, 20 bp, Artificial Sequence
  Description of Artificial Sequence: Synthetic primer
ttggtggagctgatggtgat

SEQ ID NO: 1448 - DNA, 20 bp, Artificial Sequence
  Description of Artificial Sequence: Synthetic primer
agaacagcctcaggccacga

SEQ ID NO: 1449 - DNA, 18 bp, Artificial Sequence
  Description of Artificial Sequence: Synthetic primer
tgaattcctggtcttggc

SEQ ID NO: 1450 - DNA, 20 bp, Artificial Sequence
  Description of Artificial Sequence: Synthetic primer
caagttgtctctgacctagc

SEQ ID NO: 1451 - DNA, 20 bp, Artificial Sequence
  Description of Artificial Sequence: Synthetic primer
gagctaggtcagagacaact

SEQ ID NO: 1452 - DNA, 20 bp, Artificial Sequence
  Description of Artificial Sequence: Synthetic primer
tgtagtcccggaccgtggtg

SEQ ID NO: 1453 - DNA, 18 bp, Artificial Sequence
  Description of Artificial Sequence: Synthetic primer
accaaggtgtgggaagtt

SEQ ID NO: 1454 - DNA, 19 bp, Artificial Sequence
  Description of Artificial Sequence: Synthetic primer
cctactgatttataattcc

SEQ ID NO: 1455 - DNA, 20 bp, Artificial Sequence
  Description of Artificial Sequence: Synthetic primer
aaggagcttactaactgtgg

SEQ ID NO: 1456 - DNA, 20 bp, Artificial Sequence
  Description of Artificial Sequence: Synthetic primer
ctctgcagtactgtatccac

SEQ ID NO: 1457 - DNA, 20 bp, Artificial Sequence
  Description of Artificial Sequence: Synthetic primer
tcgtgtggatacagtactgc

SEQ ID NO: 1458 - DNA, 20 bp, Artificial Sequence
  Description of Artificial Sequence: Synthetic primer
gcctcattctctgcattcac

SEQ ID NO: 1459 - DNA, 20 bp, Artificial Sequence
  Description of Artificial Sequence: Synthetic primer
ctctttctggatacagagac

SEQ ID NO: 1460 - DNA, 19 bp, Artificial Sequence
  Description of Artificial Sequence: Synthetic primer
agaagtggtattttggttt

SEQ ID NO: 1461 - DNA, 21 bp, Artificial Sequence
  Description of Artificial Sequence: Synthetic primer
ctttcagtccaaaatagttag

SEQ ID NO: 1462 - DNA, 21 bp, Artificial Sequence
  Description of Artificial Sequence: Synthetic primer
ctgaaaagactaatgggatgc

SEQ ID NO: 1463 - DNA, 19 bp, Artificial Sequence
  Description of Artificial Sequence: Synthetic primer
gagaagaaaagcatcatag

SEQ ID NO: 1464 - DNA, 20 bp, Artificial Sequence
  Description of Artificial Sequence: Synthetic primer
tatcaactgagataggtggg

SEQ ID NO: 1465 - DNA, 20 bp, Artificial Sequence
  Description of Artificial Sequence: Synthetic primer
aggtttcccacctatctcag

SEQ ID NO: 1466 - DNA, 20 bp, Artificial Sequence
  Description of Artificial Sequence: Synthetic primer
aggtttcccacctatctcag

SEQ ID NO: 1467 - DNA, 20 bp, Artificial Sequence
  Description of Artificial Sequence: Synthetic primer
gttatctattccatttgaca

SEQ ID NO: 1468 - DNA, 19 bp, Artificial Sequence
  Description of Artificial Sequence: Synthetic primer
cacaattagggctaataaa

SEQ ID NO: 1469 - DNA, 21 bp, Artificial Sequence
  Description of Artificial Sequence: Synthetic primer
ggttagaaaataagtgtacta

SEQ ID NO: 1470 - DNA, 20 bp, Artificial Sequence
  Description of Artificial Sequence: Synthetic primer
acatgacagtttcttatatt

SEQ ID NO: 1471 - DNA, 19 bp, Artificial Sequence
  Description of Artificial Sequence: Synthetic primer
ttagtttactgcttccatg

SEQ ID NO: 1472 - DNA, 21 bp, Artificial Sequence
  Description of Artificial Sequence: Synthetic primer
cttccataatcttactctgtg

SEQ ID NO: 1473 - DNA, 20 bp, Artificial Sequence
  Description of Artificial Sequence: Synthetic primer
cctctatttcacagagtaag

SEQ ID NO: 1474 - DNA, 19 bp, Artificial Sequence
  Description of Artificial Sequence: Synthetic primer
gatttgagtgcatgtttta

SEQ ID NO: 1475 - DNA, 20 bp, Artificial Sequence
  Description of Artificial Sequence: Synthetic primer
acagccatgttcccaccagg

SEQ ID NO: 1476 - DNA, 19 bp, Artificial Sequence
  Description of Artificial Sequence: Synthetic primer
caggtctccaggtcagcag

SEQ ID NO: 1477 - DNA, 20 bp, Artificial Sequence
  Description of Artificial Sequence: Synthetic primer
atatagctagcaaggctggg

SEQ ID NO: 1478 - DNA, 19 bp, Artificial Sequence
  Description of Artificial Sequence: Synthetic primer
tgctgacctggagacctgc

SEQ ID NO: 1479 - DNA, 20 bp, Artificial Sequence
  Description of Artificial Sequence: Synthetic primer
tctcagaggtatgactgagc

SEQ ID NO: 1480 - DNA, 20 bp, Artificial Sequence
  Description of Artificial Sequence: Synthetic primer
tatgatttgaaatcattcag

SEQ ID NO: 1481 - DNA, 19 bp, Artificial Sequence
  Description of Artificial Sequence: Synthetic primer
ttagtctttcttgctggga

SEQ ID NO: 1482 - DNA, 20 bp, Artificial Sequence
  Description of Artificial Sequence: Synthetic primer
tataacacatccccacatgc

SEQ ID NO: 1483 - DNA, 20 bp, Artificial Sequence
  Description of Artificial Sequence: Synthetic primer
acaggtcattgaaacagaca

SEQ ID NO: 1484 - DNA, 19 bp, Artificial Sequence
  Description of Artificial Sequence: Synthetic primer
aatgtctgtttcaatgacc

SEQ ID NO: 1485 - DNA, 20 bp, Artificial Sequence
  Description of Artificial Sequence: Synthetic primer
ggacacaagtgcaggttcag

SEQ ID NO: 1486 - DNA, 20 bp, Artificial Sequence
  Description of Artificial Sequence: Synthetic primer
tctctctggatggcttcttg

SEQ ID NO: 1487 - DNA, 18 bp, Artificial Sequence
  Description of Artificial Sequence: Synthetic primer
tggagtaagaattggggt

SEQ ID NO: 1488 - DNA, 20 bp, Artificial Sequence
  Description of Artificial Sequence: Synthetic primer
gtacttgagagaaactaggg

SEQ ID NO: 1489 - DNA, 20 bp, Artificial Sequence
  Description of Artificial Sequence: Synthetic primer
tctgctggagactgtgtctt

SEQ ID NO: 1490 - DNA, 20 bp, Artificial Sequence
  Description of Artificial Sequence: Synthetic primer
ctgaagctcaagcaagcaag

SEQ ID NO: 1491 - DNA, 18 bp, Artificial Sequence
  Description of Artificial Sequence: Synthetic primer
cgaaggagtaggtggtgg

SEQ ID NO: 1492 - DNA, 19 bp, Artificial Sequence
  Description of Artificial Sequence: Synthetic primer
aaccatggtttgggtttac

SEQ ID NO: 1493 - DNA, 18 bp, Artificial Sequence
  Description of Artificial Sequence: Synthetic primer
ttgtaaacccaaaccatg

SEQ ID NO: 1494 - DNA, 20 bp, Artificial Sequence
  Description of Artificial Sequence: Synthetic primer
gtgaattcttcccacttctc

SEQ ID NO: 1495 - DNA, 19 bp, Artificial Sequence
  Description of Artificial Sequence: Synthetic primer
tcttatgttttcccatatc

SEQ ID NO: 1496 - DNA, 21 bp, Artificial Sequence
  Description of Artificial Sequence: Synthetic primer
gacatctagatatgggaaaac

SEQ ID NO: 1497 - DNA, 19 bp, Artificial Sequence
  Description of Artificial Sequence: Synthetic primer
ttaacatgttttctctcac

SEQ ID NO: 1498 - DNA, 21 bp, Artificial Sequence
  Description of Artificial Sequence: Synthetic primer
ctttcttacaacctatgactc

SEQ ID NO: 1499 - DNA, 21 bp, Artificial Sequence
  Description of Artificial Sequence: Synthetic primer
ctattggcaattctgtaattc

SEQ ID NO: 1500 - DNA, 20 bp, Artificial Sequence
  Description of Artificial Sequence: Synthetic primer
cttcactacttgtactgctg

SEQ ID NO: 1501 - DNA, 19 bp, Artificial Sequence
  Description of Artificial Sequence: Synthetic primer
tattcagttcttcattctc

SEQ ID NO: 1502 - DNA, 20 bp, Artificial Sequence
  Description of Artificial Sequence: Synthetic primer
ggacactaaacaaagacagg

SEQ ID NO: 1503 - DNA, 20 bp, Artificial Sequence
  Description of Artificial Sequence: Synthetic primer
ggacactaaacaaagacagg

SEQ ID NO: 1504 - DNA, 20 bp, Artificial Sequence
  Description of Artificial Sequence: Synthetic primer
attggccaacatctcaacag

SEQ ID NO: 1505 - DNA, 19 bp, Artificial Sequence
  Description of Artificial Sequence: Synthetic primer
tttcatttagcattcccag

SEQ ID NO: 1506 - DNA, 20 bp, Artificial Sequence
  Description of Artificial Sequence: Synthetic primer
ttcccagccatactctggac

SEQ ID NO: 1507 - DNA, 20 bp, Artificial Sequence
  Description of Artificial Sequence: Synthetic primer
aataaagtccagagtatggc

SEQ ID NO: 1508 - DNA, 20 bp, Artificial Sequence
  Description of Artificial Sequence: Synthetic primer
tgatggtggttgtgaaagtg

SEQ ID NO: 1509 - DNA, 20 bp, Artificial Sequence
  Description of Artificial Sequence: Synthetic primer
ctttcacaaccaccatcaag

SEQ ID NO: 1510 - DNA, 20 bp, Artificial Sequence
  Description of Artificial Sequence: Synthetic primer
ctcaatgcaaaggacaaatc

SEQ ID NO: 1511 - DNA, 20 bp, Artificial Sequence
  Description of Artificial Sequence: Synthetic primer
aggaccaataaacagcctcc

SEQ ID NO: 1512 - DNA, 18 bp, Artificial Sequence
  Description of Artificial Sequence: Synthetic primer
gatgccaacgtcctttcc

SEQ ID NO: 1513 - DNA, 21 bp, Artificial Sequence
  Description of Artificial Sequence: Synthetic primer
cacagcccaaatgtgtaaatg

SEQ ID NO: 1514 - DNA, 18 bp, Artificial Sequence
  Description of Artificial Sequence: Synthetic primer
ccaccccagtcatctctg

SEQ ID NO: 1515 - DNA, 20 bp, Artificial Sequence
  Description of Artificial Sequence: Synthetic primer
caaaaatcattattctgtgc

SEQ ID NO: 1516 - DNA, 20 bp, Artificial Sequence
  Description of Artificial Sequence: Synthetic primer
actcaggagtacttatgaga

SEQ ID NO: 1517 - DNA, 20 bp, Artificial Sequence
  Description of Artificial Sequence: Synthetic primer
cttgagacactaatacagag

SEQ ID NO: 1518 - DNA, 20 bp, Artificial Sequence
  Description of Artificial Sequence: Synthetic primer
gtgtgcttgcctcctaattt

SEQ ID NO: 1519 - DNA, 20 bp, Artificial Sequence
  Description of Artificial Sequence: Synthetic primer
tgacttggacggtcaaaagg

SEQ ID NO: 1520 - DNA, 21 bp, Artificial Sequence
  Description of Artificial Sequence: Synthetic primer
gtgaaattttgggtgccaaac

SEQ ID NO: 1521 - DNA, 19 bp, Artificial Sequence
  Description of Artificial Sequence: Synthetic primer
ggcctctaatttatattgc

SEQ ID NO: 1522 - DNA, 20 bp, Artificial Sequence
  Description of Artificial Sequence: Synthetic primer
gaaaaggaacatagaatctg

SEQ ID NO: 1523 - DNA, 21 bp, Artificial Sequence
  Description of Artificial Sequence: Synthetic primer
acatttgaaacattagatttt

SEQ ID NO: 1524 - DNA, 20 bp, Artificial Sequence
  Description of Artificial Sequence: Synthetic primer
gcaaagcagcctaactcttc

SEQ ID NO: 1525 - DNA, 20 bp, Artificial Sequence
  Description of Artificial Sequence: Synthetic primer
gaagctaaggtctccttctc

SEQ ID NO: 1526 - DNA, 20 bp, Artificial Sequence
  Description of Artificial Sequence: Synthetic primer
taaatgtgcctcccagtgcc

SEQ ID NO: 1527 - DNA, 20 bp, Artificial Sequence
  Description of Artificial Sequence: Synthetic primer
tccttggaacaggtcaccat

SEQ ID NO: 1528 - DNA, 20 bp, Artificial Sequence
  Description of Artificial Sequence: Synthetic primer
gaaagtcctttccatagggg

SEQ ID NO: 1529 - DNA, 20 bp, Artificial Sequence
  Description of Artificial Sequence: Synthetic primer
tgcaacatgggcttcaggta

SEQ ID NO: 1530 - DNA, 20 bp, Artificial Sequence
  Description of Artificial Sequence: Synthetic primer
ccttgctgaaaggttaaatc

SEQ ID NO: 1531 - DNA, 20 bp, Artificial Sequence
  Description of Artificial Sequence: Synthetic primer
ttgtcgcccactgttcctgt

SEQ ID NO: 1532 - DNA, 19 bp, Artificial Sequence
  Description of Artificial Sequence: Synthetic primer
ttgtcgcccactgttcctg

SEQ ID NO: 1533 - DNA, 20 bp, Artificial Sequence
  Description of Artificial Sequence: Synthetic primer
aggtgattgggatgtacgac

SEQ ID NO: 1534 - DNA, 20 bp, Artificial Sequence
  Description of Artificial Sequence: Synthetic primer
atgagctggccttcaacaag

SEQ ID NO: 1535 - DNA, 20 bp, Artificial Sequence
  Description of Artificial Sequence: Synthetic primer
cccacttgtccattgacttc

SEQ ID NO: 1536 - DNA, 20 bp, Artificial Sequence
  Description of Artificial Sequence: Synthetic primer
tgggcagtgatatgggatag

SEQ ID NO: 1537 - DNA, 20 bp, Artificial Sequence
  Description of Artificial Sequence: Synthetic primer
agaagaactcactgcagagc

SEQ ID NO: 1538 - DNA, 20 bp, Artificial Sequence
  Description of Artificial Sequence: Synthetic primer
ttacttgcagagataggagc

SEQ ID NO: 1539 - DNA, 18 bp, Artificial Sequence
  Description of Artificial Sequence: Synthetic primer
tcccaaacttgggcaaag

SEQ ID NO: 1540 - DNA, 20 bp, Artificial Sequence
  Description of Artificial Sequence: Synthetic primer
tcctcttcttaatgggaagc

SEQ ID NO: 1541 - DNA, 19 bp, Artificial Sequence
  Description of Artificial Sequence: Synthetic primer
tacctttttctcaacatga

SEQ ID NO: 1542 - DNA, 20 bp, Artificial Sequence
  Description of Artificial Sequence: Synthetic primer
ttggcagtatgtataatggc

SEQ ID NO: 1543 - DNA, 21 bp, Artificial Sequence
  Description of Artificial Sequence: Synthetic primer
caatactgaactgtacaagag

SEQ ID NO: 1544 - DNA, 20 bp, Artificial Sequence
  Description of Artificial Sequence: Synthetic primer
tttagtaatacaaaaaagcc

SEQ ID NO: 1545 - DNA, 20 bp, Artificial Sequence
  Description of Artificial Sequence: Synthetic primer
ggtggattttcctccaagtg

SEQ ID NO: 1546 - DNA, 19 bp, Artificial Sequence
  Description of Artificial Sequence: Synthetic primer
ttttagttagggtttcttg

SEQ ID NO: 1547 - DNA, 19 bp, Artificial Sequence
  Description of Artificial Sequence: Synthetic primer
cccttctaagtgttatttg

SEQ ID NO: 1548 - DNA, 20 bp, Artificial Sequence
  Description of Artificial Sequence: Synthetic primer
ttaattggaataatggatca

SEQ ID NO: 1549 - DNA, 21 bp, Artificial Sequence
  Description of Artificial Sequence: Synthetic primer
gcttagtgcttggctaatttc

SEQ ID NO: 1550 - DNA, 19 bp, Artificial Sequence
  Description of Artificial Sequence: Synthetic primer
gagaaaatttcataaagcc

SEQ ID NO: 1551 - DNA, 20 bp, Artificial Sequence
  Description of Artificial Sequence: Synthetic primer
tctgaagttttcaagctctg

SEQ ID NO: 1552 - DNA, 20 bp, Artificial Sequence
  Description of Artificial Sequence: Synthetic primer
tgagacttctaggtcttagg

SEQ ID NO: 1553 - DNA, 19 bp, Artificial Sequence
  Description of Artificial Sequence: Synthetic primer
taagacctagaagtctcag

SEQ ID NO: 1554 - DNA, 20 bp, Artificial Sequence
  Description of Artificial Sequence: Synthetic primer
gagatggaatgtaactttgc

SEQ ID NO: 1555 - DNA, 20 bp, Artificial Sequence
  Description of Artificial Sequence: Synthetic primer
gcaaagttacattccatctc

SEQ ID NO: 1556 - DNA, 20 bp, Artificial Sequence
  Description of Artificial Sequence: Synthetic primer
ctgcagtcatcttggacctt

SEQ ID NO: 1557 - DNA, 19 bp, Artificial Sequence
  Description of Artificial Sequence: Synthetic primer
attaaggtcataaaccagc

SEQ ID NO: 1558 - DNA, 20 bp, Artificial Sequence
  Description of Artificial Sequence: Synthetic primer
gatcatagtcttaggagttc

SEQ ID NO: 1559 - DNA, 19 bp, Artificial Sequence
  Description of Artificial Sequence: Synthetic primer
acaacactacaagtcttga

SEQ ID NO: 1560 - DNA, 20 bp, Artificial Sequence
  Description of Artificial Sequence: Synthetic primer
gtgttgtaaacctgcctcac

SEQ ID NO: 1561 - DNA, 20 bp, Artificial Sequence
  Description of Artificial Sequence: Synthetic primer
tgagagctccaactccaaac

SEQ ID NO: 1562 - DNA, 20 bp, Artificial Sequence
  Description of Artificial Sequence: Synthetic primer
actcagacgtggtggaaaac

SEQ ID NO: 1563 - DNA, 20 bp, Artificial Sequence
  Description of Artificial Sequence: Synthetic primer
gtcagctaatgccacatggt

SEQ ID NO: 1564 - DNA, 20 bp, Artificial Sequence
  Description of Artificial Sequence: Synthetic primer
agatgagtgagcaggaagag

SEQ ID NO: 1565 - DNA, 20 bp, Artificial Sequence
  Description of Artificial Sequence: Synthetic primer
tgatgagatgagtgagcagg

SEQ ID NO: 1566 - DNA, 20 bp, Artificial Sequence
  Description of Artificial Sequence: Synthetic primer
agaaacaaagtggaagatgc

SEQ ID NO: 1567 - DNA, 20 bp, Artificial Sequence
  Description of Artificial Sequence: Synthetic primer
ccacccacatttttctcagc

SEQ ID NO: 1568 - DNA, 20 bp, Artificial Sequence
  Description of Artificial Sequence: Synthetic primer
gttgcaaataatttggtgag

SEQ ID NO: 1569 - DNA, 20 bp, Artificial Sequence
  Description of Artificial Sequence: Synthetic primer
ttctcccacccacatttttc

SEQ ID NO: 1570 - DNA, 20 bp, Artificial Sequence
  Description of Artificial Sequence: Synthetic primer
tgtagtgatgggagggattc

SEQ ID NO: 1571 - DNA, 18 bp, Artificial Sequence
  Description of Artificial Sequence: Synthetic primer
gtctcatgggctgcaaac

SEQ ID NO: 1572 - DNA, 19 bp, Artificial Sequence
  Description of Artificial Sequence: Synthetic primer
gatacctactgaattattg

SEQ ID NO: 1573 - DNA, 20 bp, Artificial Sequence
  Description of Artificial Sequence: Synthetic primer
gaaaatgccaactttctggg

SEQ ID NO: 1574 - DNA, 19 bp, Artificial Sequence
  Description of Artificial Sequence: Synthetic primer
gactggaaactgttgaaag

SEQ ID NO: 1575 - DNA, 21 bp, Artificial Sequence
  Description of Artificial Sequence: Synthetic primer
ggatactttcatttgtccctg

SEQ ID NO: 1576 - DNA, 20 bp, Artificial Sequence
  Description of Artificial Sequence: Synthetic primer
atgtgtaccagggacaaatg

SEQ ID NO: 1577 - DNA, 18 bp, Artificial Sequence
  Description of Artificial Sequence: Synthetic primer
cccaaattattgtcaagc

SEQ ID NO: 1578 - DNA, 20 bp, Artificial Sequence
  Description of Artificial Sequence: Synthetic primer
aatctccagtaaactctagg

SEQ ID NO: 1579 - DNA, 20 bp, Artificial Sequence
  Description of Artificial Sequence: Synthetic primer
cagaatatgcagtgtctgag

SEQ ID NO: 1580 - DNA, 20 bp, Artificial Sequence
  Description of Artificial Sequence: Synthetic primer
tcagggtacaagcagctgtc

SEQ ID NO: 1581 - DNA, 19 bp, Artificial Sequence
  Description of Artificial Sequence: Synthetic primer
ttatctatagaaacactcc

SEQ ID NO: 1582 - DNA, 20 bp, Artificial Sequence
  Description of Artificial Sequence: Synthetic primer
catcattccctatttgactg

SEQ ID NO: 1583 - DNA, 20 bp, Artificial Sequence
  Description of Artificial Sequence: Synthetic primer
tttcttaaccagagagcttc

SEQ ID NO: 1584 - DNA, 20 bp, Artificial Sequence
  Description of Artificial Sequence: Synthetic primer
ttcccagggcccaaagcaag

SEQ ID NO: 1585 - DNA, 20 bp, Artificial Sequence
  Description of Artificial Sequence: Synthetic primer
ctaagtaaatcaggctttgg

SEQ ID NO: 1586 - DNA, 21 bp, Artificial Sequence
  Description of Artificial Sequence: Synthetic primer
gatggaatttctctttgcacc

SEQ ID NO: 1587 - DNA, 19 bp, Artificial Sequence
  Description of Artificial Sequence: Synthetic primer
tctgtgctaggagaaggag

SEQ ID NO: 1588 - DNA, 21 bp, Artificial Sequence
  Description of Artificial Sequence: Synthetic primer
ggaaaactcaaacatggactg

SEQ ID NO: 1589 - DNA, 20 bp, Artificial Sequence
  Description of Artificial Sequence: Synthetic primer
cactccagtccatgtttgag

SEQ ID NO: 1590 - DNA, 21 bp, Artificial Sequence
  Description of Artificial Sequence: Synthetic primer
ggattaagtatatgtctgttg

SEQ ID NO: 1591 - DNA, 20 bp, Artificial Sequence
  Description of Artificial Sequence: Synthetic primer
gtgttttgaaatcaacagac

SEQ ID NO: 1592 - DNA, 20 bp, Artificial Sequence
  Description of Artificial Sequence: Synthetic primer
gagaattaaaatgaactgag

SEQ ID NO: 1593 - DNA, 21 bp, Artificial Sequence
  Description of Artificial Sequence: Synthetic primer
ctggttttgaattacattggc

SEQ ID NO: 1594 - DNA, 19 bp, Artificial Sequence
  Description of Artificial Sequence: Synthetic primer
actgcatatatcttctgcc

SEQ ID NO: 1595 - DNA, 19 bp, Artificial Sequence
  Description of Artificial Sequence: Synthetic primer
agaatgacaactgacattt

SEQ ID NO: 1596 - DNA, 18 bp, Artificial Sequence
  Description of Artificial Sequence: Synthetic primer
ctgcccttttcaattctg

SEQ ID NO: 1597 - DNA, 20 bp, Artificial Sequence
  Description of Artificial Sequence: Synthetic primer
ctgtgaaaccatgggaagtt

SEQ ID NO: 1598 - DNA, 20 bp, Artificial Sequence
  Description of Artificial Sequence: Synthetic primer
ctgtgaaaccatgggaagtt

SEQ ID NO: 1599 - DNA, 20 bp, Artificial Sequence
  Description of Artificial Sequence: Synthetic primer
ataacttcccatggtttcac

SEQ ID NO: 1600 - DNA, 20 bp, Artificial Sequence
  Description of Artificial Sequence: Synthetic primer
gagacattgtccttttgaag

SEQ ID NO: 1601 - DNA, 20 bp, Artificial Sequence
  Description of Artificial Sequence: Synthetic primer
ttgtccttttgaagatgtgg

SEQ ID NO: 1602 - DNA, 20 bp, Artificial Sequence
  Description of Artificial Sequence: Synthetic primer
gcagcagggtataacaaagc

SEQ ID NO: 1603 - DNA, 19 bp, Artificial Sequence
  Description of Artificial Sequence: Synthetic primer
tatctgtgtagcagcaggg

SEQ ID NO: 1604 - DNA, 21 bp, Artificial Sequence
  Description of Artificial Sequence: Synthetic primer
ctgtttgactattctgatctc

SEQ ID NO: 1605 - DNA, 20 bp, Artificial Sequence
  Description of Artificial Sequence: Synthetic primer
cttaagagatcagaatagtc

SEQ ID NO: 1606 - DNA, 21 bp, Artificial Sequence
  Description of Artificial Sequence: Synthetic primer
ccatcttcaagttttaagcac

SEQ ID NO: 1607 - DNA, 19 bp, Artificial Sequence
  Description of Artificial Sequence: Synthetic primer
acgaggtcaaatctgctcc

SEQ ID NO: 1608 - DNA, 20 bp, Artificial Sequence
  Description of Artificial Sequence: Synthetic primer
cagatttgacctcgtctctc

SEQ ID NO: 1609 - DNA, 20 bp, Artificial Sequence
  Description of Artificial Sequence: Synthetic primer
atgcagtgcttaggaagtgg

SEQ ID NO: 1610 - DNA, 20 bp, Artificial Sequence
  Description of Artificial Sequence: Synthetic primer
tgccactgcaccaggagaaa

SEQ ID NO: 1611 - DNA, 20 bp, Artificial Sequence
  Description of Artificial Sequence: Synthetic primer
tcttttggaatgggagggag

SEQ ID NO: 1612 - DNA, 20 bp, Artificial Sequence
  Description of Artificial Sequence: Synthetic primer
tccctcccattccaaaagag

SEQ ID NO: 1613 - DNA, 20 bp, Artificial Sequence
  Description of Artificial Sequence: Synthetic primer
tgcttcagctaggtgcttac

SEQ ID NO: 1614 - DNA, 20 bp, Artificial Sequence
  Description of Artificial Sequence: Synthetic primer
ggagaagagcatagctagac

SEQ ID NO: 1615 - DNA, 20 bp, Artificial Sequence
  Description of Artificial Sequence: Synthetic primer
gaggctggagaagagcatag

SEQ ID NO: 1616 - DNA, 20 bp, Artificial Sequence
  Description of Artificial Sequence: Synthetic primer
gtctagctatgctcttctcc

SEQ ID NO: 1617 - DNA, 20 bp, Artificial Sequence
  Description of Artificial Sequence: Synthetic primer
tctttgaaacagcatgactc

SEQ ID NO: 1618 - DNA, 20 bp, Artificial Sequence
  Description of Artificial Sequence: Synthetic primer
tggtgtttatggatgagtgg

SEQ ID NO: 1619 - DNA, 20 bp, Artificial Sequence
  Description of Artificial Sequence: Synthetic primer
ggtaccactcatccataaac

SEQ ID NO: 1620 - DNA, 20 bp, Artificial Sequence
  Description of Artificial Sequence: Synthetic primer
tgtgtatcataaagtccctc

SEQ ID NO: 1621 - DNA, 20 bp, Artificial Sequence
  Description of Artificial Sequence: Synthetic primer
gggaggatgtctgtgtctaa

SEQ ID NO: 1622 - DNA, 20 bp, Artificial Sequence
  Description of Artificial Sequence: Synthetic primer
ctctcttctggaaatcatcg

SEQ ID NO: 1623 - DNA, 18 bp, Artificial Sequence
  Description of Artificial Sequence: Synthetic primer
aacagccaaaagcctatc

SEQ ID NO: 1624 - DNA, 19 bp, Artificial Sequence
  Description of Artificial Sequence: Synthetic primer
tatgggagagggtaaaaag

SEQ ID NO: 1625 - DNA, 20 bp, Artificial Sequence
  Description of Artificial Sequence: Synthetic primer
agttagttaccaactcctag

SEQ ID NO: 1626 - DNA, 20 bp, Artificial Sequence
  Description of Artificial Sequence: Synthetic primer
gttaccaactcctagaagcc

SEQ ID NO: 1627 - DNA, 20 bp, Artificial Sequence
  Description of Artificial Sequence: Synthetic primer
ttccgcagcccacagctaag

SEQ ID NO: 1628 - DNA, 19 bp, Artificial Sequence
  Description of Artificial Sequence: Synthetic primer
ggcagcgaaggggcctcac

SEQ ID NO: 1629 - DNA, 20 bp, Artificial Sequence
  Description of Artificial Sequence: Synthetic primer
tgtaaacacaacgcaggaac

SEQ ID NO: 1630 - DNA, 18 bp, Artificial Sequence
  Description of Artificial Sequence: Synthetic primer
gaagccacaggctcacag

SEQ ID NO: 1631 - DNA, 20 bp, Artificial Sequence
  Description of Artificial Sequence: Synthetic primer
gaaagttcttgtattaaaag

SEQ ID NO: 1632 - DNA, 20 bp, Artificial Sequence
  Description of Artificial Sequence: Synthetic primer
accctcagtaccactatctc

SEQ ID NO: 1633 - DNA, 20 bp, Artificial Sequence
  Description of Artificial Sequence: Synthetic primer
caaggattccagtactggag

SEQ ID NO: 1634 - DNA, 20 bp, Artificial Sequence
  Description of Artificial Sequence: Synthetic primer
acgtaagtccccacagtttg

SEQ ID NO: 1635 - DNA, 20 bp, Artificial Sequence
  Description of Artificial Sequence: Synthetic primer
ctcccaaactgtggggactt

SEQ ID NO: 1636 - DNA, 21 bp, Artificial Sequence
  Description of Artificial Sequence: Synthetic primer
gaaaattgcatctggctacac

SEQ ID NO: 1637 - DNA, 19 bp, Artificial Sequence
  Description of Artificial Sequence: Synthetic primer
tgttcttggttgactttac

SEQ ID NO: 1638 - DNA, 20 bp, Artificial Sequence
  Description of Artificial Sequence: Synthetic primer
ctgttcctgagctgattggg

SEQ ID NO: 1639 - DNA, 20 bp, Artificial Sequence
  Description of Artificial Sequence: Synthetic primer
ctgttcctgagctgattggg

SEQ ID NO: 1640 - DNA, 20 bp, Artificial Sequence
  Description of Artificial Sequence: Synthetic primer
aggacatggggctggttttg

SEQ ID NO: 1641 - DNA, 19 bp, Artificial Sequence
  Description of Artificial Sequence: Synthetic primer
aggacatggggctggtttt

SEQ ID NO: 1642 - DNA, 20 bp, Artificial Sequence
  Description of Artificial Sequence: Synthetic primer
tcctgtgtttctaggaaggc

SEQ ID NO: 1643 - DNA, 20 bp, Artificial Sequence
  Description of Artificial Sequence: Synthetic primer
gaaacacaggaataacctgc

SEQ ID NO: 1644 - DNA, 20 bp, Artificial Sequence
  Description of Artificial Sequence: Synthetic primer
cctgtcagttcaatgtgtaa

SEQ ID NO: 1645 - DNA, 21 bp, Artificial Sequence
  Description of Artificial Sequence: Synthetic primer
gtgcttttacacattgaactg

SEQ ID NO: 1646 - DNA, 19 bp, Artificial Sequence
  Description of Artificial Sequence: Synthetic primer
aggcatcgactgtcacagg

SEQ ID NO: 1647 - DNA, 20 bp, Artificial Sequence
  Description of Artificial Sequence: Synthetic primer
agctgcctttattcgtgctc

SEQ ID NO: 1648 - DNA, 20 bp, Artificial Sequence
  Description of Artificial Sequence: Synthetic primer
acttgagcacgaataaaggc

SEQ ID NO: 1649 - DNA, 20 bp, Artificial Sequence
  Description of Artificial Sequence: Synthetic primer
ggcagcaaaaacattaattc

SEQ ID NO: 1650 - DNA, 19 bp, Artificial Sequence
  Description of Artificial Sequence: Synthetic primer
tcttcctttcagcctccag

SEQ ID NO: 1651 - DNA, 20 bp, Artificial Sequence
  Description of Artificial Sequence: Synthetic primer
caaaaagacctgctagagcc

SEQ ID NO: 1652 - DNA, 19 bp, Artificial Sequence
  Description of Artificial Sequence: Synthetic primer
catgctggaagtccaggct

SEQ ID NO: 1653 - DNA, 21 bp, Artificial Sequence
  Description of Artificial Sequence: Synthetic primer
cagcaaagaaaaccaagagtc

SEQ ID NO: 1654 - DNA, 19 bp, Artificial Sequence
  Description of Artificial Sequence: Synthetic primer
tgccagcagaacccaagac

SEQ ID NO: 1655 - DNA, 19 bp, Artificial Sequence
  Description of Artificial Sequence: Synthetic primer
tgttggggctggggcctgt

SEQ ID NO: 1656 - DNA, 20 bp, Artificial Sequence
  Description of Artificial Sequence: Synthetic primer
ctggcatcctcgtgaaagtg

SEQ ID NO: 1657 - DNA, 19 bp, Artificial Sequence
  Description of Artificial Sequence: Synthetic primer
tgaaaggcaggaacgtggt

SEQ ID NO: 1658 - DNA, 19 bp, Artificial Sequence
  Description of Artificial Sequence: Synthetic primer
ggtttagggactgaataac

SEQ ID NO: 1659 - DNA, 19 bp, Artificial Sequence
  Description of Artificial Sequence: Synthetic primer
agtctattggatttaaacc

SEQ ID NO: 1660 - DNA, 21 bp, Artificial Sequence
  Description of Artificial Sequence: Synthetic primer
ctcaataagagtcttattgcc

SEQ ID NO: 1661 - DNA, 20 bp, Artificial Sequence
  Description of Artificial Sequence: Synthetic primer
ttgccgcaccataaatccac

SEQ ID NO: 1662 - DNA, 21 bp, Artificial Sequence
  Description of Artificial Sequence: Synthetic primer
cacaaactacctagatgacac

SEQ ID NO: 1663 - DNA, 20 bp, Artificial Sequence
  Description of Artificial Sequence: Synthetic primer
ccctcaattagagggttgac

SEQ ID NO: 1664 - DNA, 19 bp, Artificial Sequence
  Description of Artificial Sequence: Synthetic primer
aaaagtacacttataagcc

SEQ ID NO: 1665 - DNA, 20 bp, Artificial Sequence
  Description of Artificial Sequence: Synthetic primer
cattcgtattccatgagacc

SEQ ID NO: 1666 - DNA, 20 bp, Artificial Sequence
  Description of Artificial Sequence: Synthetic primer
gtaagagtgatctaaatccc

SEQ ID NO: 1667 - DNA, 20 bp, Artificial Sequence
  Description of Artificial Sequence: Synthetic primer
cacacgtgttgagtaggctt

SEQ ID NO: 1668 - DNA, 20 bp, Artificial Sequence
  Description of Artificial Sequence: Synthetic primer
tcaggagtggagagaaaagc

SEQ ID NO: 1669 - DNA, 20 bp, Artificial Sequence
  Description of Artificial Sequence: Synthetic primer
ggctcctagaatttatagtc

SEQ ID NO: 1670 - DNA, 20 bp, Artificial Sequence
  Description of Artificial Sequence: Synthetic primer
tgtttatgcaggagtgccag

SEQ ID NO: 1671 - DNA, 21 bp, Artificial Sequence
  Description of Artificial Sequence: Synthetic primer
gtgaatacttcacaatgaatc

SEQ ID NO: 1672 - DNA, 21 bp, Artificial Sequence
  Description of Artificial Sequence: Synthetic primer
gtccaagtatgaacaaaagcc

SEQ ID NO: 1673 - DNA, 20 bp, Artificial Sequence
  Description of Artificial Sequence: Synthetic primer
acaccatctgttccttccac

SEQ ID NO: 1674 - DNA, 20 bp, Artificial Sequence
  Description of Artificial Sequence: Synthetic primer
atccctgttggtagggaaag

SEQ ID NO: 1675 - DNA, 20 bp, Artificial Sequence
  Description of Artificial Sequence: Synthetic primer
aacactgcactaagcagcac

SEQ ID NO: 1676 - DNA, 20 bp, Artificial Sequence
  Description of Artificial Sequence: Synthetic primer
agagacctggacctgaagac

SEQ ID NO: 1677 - DNA, 20 bp, Artificial Sequence
  Description of Artificial Sequence: Synthetic primer
gccattatcagattgttatg

SEQ ID NO: 1678 - DNA, 20 bp, Artificial Sequence
  Description of Artificial Sequence: Synthetic primer
ccacctaggacgttttattg

SEQ ID NO: 1679 - DNA, 21 bp, Artificial Sequence
  Description of Artificial Sequence: Synthetic primer
ggtttttctctgagatttggc

SEQ ID NO: 1680 - DNA, 20 bp, Artificial Sequence
  Description of Artificial Sequence: Synthetic primer
gaactgtctactgccaacat

SEQ ID NO: 1681 - DNA, 20 bp, Artificial Sequence
  Description of Artificial Sequence: Synthetic primer
acagtgtaaaaagtgctgca

SEQ ID NO: 1682 - DNA, 20 bp, Artificial Sequence
  Description of Artificial Sequence: Synthetic primer
ctacaatccagttgcagcac

SEQ ID NO: 1683 - DNA, 18 bp, Artificial Sequence
  Description of Artificial Sequence: Synthetic primer
taagtgctgaacagggtg

SEQ ID NO: 1684 - DNA, 20 bp, Artificial Sequence
  Description of Artificial Sequence: Synthetic primer
tactggtggaggcattagtg

SEQ ID NO: 1685 - DNA, 20 bp, Artificial Sequence
  Description of Artificial Sequence: Synthetic primer
ccaccagtaataacctagaa

SEQ ID NO: 1686 - DNA, 20 bp, Artificial Sequence
  Description of Artificial Sequence: Synthetic primer
aaacactacctggcagggac

SEQ ID NO: 1687 - DNA, 21 bp, Artificial Sequence
  Description of Artificial Sequence: Synthetic primer
gttgcttctaaatagcctatc

SEQ ID NO: 1688 - DNA, 19 bp, Artificial Sequence
  Description of Artificial Sequence: Synthetic primer
cttttaccagttatcttcc

SEQ ID NO: 1689 - DNA, 20 bp, Artificial Sequence
  Description of Artificial Sequence: Synthetic primer
ccaaggttgcttataaacag

SEQ ID NO: 1690 - DNA, 19 bp, Artificial Sequence
  Description of Artificial Sequence: Synthetic primer
ttattgaaggctaaagctg

SEQ ID NO: 1691 - DNA, 20 bp, Artificial Sequence
  Description of Artificial Sequence: Synthetic primer
accctgtatgtatcatcacg

SEQ ID NO: 1692 - DNA, 20 bp, Artificial Sequence
  Description of Artificial Sequence: Synthetic primer
gtattcccattctaattagg

SEQ ID NO: 1693 - DNA, 21 bp, Artificial Sequence
  Description of Artificial Sequence: Synthetic primer
caatatccaatttgctgtctg

SEQ ID NO: 1694 - DNA, 20 bp, Artificial Sequence
  Description of Artificial Sequence: Synthetic primer
ttctgttgttcatggaacac

SEQ ID NO: 1695 - DNA, 21 bp, Artificial Sequence
  Description of Artificial Sequence: Synthetic primer
caattctttggtctttaccag

SEQ ID NO: 1696 - DNA, 20 bp, Artificial Sequence
  Description of Artificial Sequence: Synthetic primer
gcccctcttgttactacttc

SEQ ID NO: 1697 - DNA, 20 bp, Artificial Sequence
  Description of Artificial Sequence: Synthetic primer
taagcctggaaatacacccc

SEQ ID NO: 1698 - DNA, 20 bp, Artificial Sequence
  Description of Artificial Sequence: Synthetic primer
ggcctagttttactgcacac

SEQ ID NO: 1699 - DNA, 20 bp, Artificial Sequence
  Description of Artificial Sequence: Synthetic primer
tccctttcgtgtaccttgtc

SEQ ID NO: 1700 - DNA, 19 bp, Artificial Sequence
  Description of Artificial Sequence: Synthetic primer
tcacaatagtaatttggag

SEQ ID NO: 1701 - DNA, 21 bp, Artificial Sequence
  Description of Artificial Sequence: Synthetic primer
cattttgccatgcagttttac

SEQ ID NO: 1702 - DNA, 20 bp, Artificial Sequence
  Description of Artificial Sequence: Synthetic primer
gtttctagtggaagagtgac

SEQ ID NO: 1703 - DNA, 20 bp, Artificial Sequence
  Description of Artificial Sequence: Synthetic primer
ctgcagttgttagaggaacc

SEQ ID NO: 1704 - DNA, 20 bp, Artificial Sequence
  Description of Artificial Sequence: Synthetic primer
agtggaagagtgacagattc

SEQ ID NO: 1705 - DNA, 19 bp, Artificial Sequence
  Description of Artificial Sequence: Synthetic primer
tcgttacacaccagatcac

SEQ ID NO: 1706 - DNA, 19 bp, Artificial Sequence
  Description of Artificial Sequence: Synthetic primer
tatcatcccaacatacagt

SEQ ID NO: 1707 - DNA, 21 bp, Artificial Sequence
  Description of Artificial Sequence: Synthetic primer
catctgggtatctactattag

SEQ ID NO: 1708 - DNA, 20 bp, Artificial Sequence
  Description of Artificial Sequence: Synthetic primer
ggttggcaggtatggttaag

SEQ ID NO: 1709 - DNA, 20 bp, Artificial Sequence
  Description of Artificial Sequence: Synthetic primer
tttgcttaaccatacctgcc

SEQ ID NO: 1710 - DNA, 21 bp, Artificial Sequence
  Description of Artificial Sequence: Synthetic primer
ccattgtcaattcttttccag

SEQ ID NO: 1711 - DNA, 18 bp, Artificial Sequence
  Description of Artificial Sequence: Synthetic primer
gtctttatcccaaagaca

SEQ ID NO: 1712 - DNA, 19 bp, Artificial Sequence
  Description of Artificial Sequence: Synthetic primer
tgctccctggtgagctgga

SEQ ID NO: 1713 - DNA, 20 bp, Artificial Sequence
  Description of Artificial Sequence: Synthetic primer
tctcagcttgttctgtctcc

SEQ ID NO: 1714 - DNA, 20 bp, Artificial Sequence
  Description of Artificial Sequence: Synthetic primer
cacccagaattctctaccag

SEQ ID NO: 1715 - DNA, 21 bp, Artificial Sequence
  Description of Artificial Sequence: Synthetic primer
gttacctctattaagcttttc

SEQ ID NO: 1716 - DNA, 20 bp, Artificial Sequence
  Description of Artificial Sequence: Synthetic primer
tgtggctgttatttagcaag

SEQ ID NO: 1717 - DNA, 21 bp, Artificial Sequence
  Description of Artificial Sequence: Synthetic primer
gacctacttgctaaataacag

SEQ ID NO: 1718 - DNA, 21 bp, Artificial Sequence
  Description of Artificial Sequence: Synthetic primer
gttagatgaagtccttttacc

SEQ ID NO: 1719 - DNA, 19 bp, Artificial Sequence
  Description of Artificial Sequence: Synthetic primer
taaacacaaatgctacacc

SEQ ID NO: 1720 - DNA, 20 bp, Artificial Sequence
  Description of Artificial Sequence: Synthetic primer
aaagagctgctgggtaactg

SEQ ID NO: 1721 - DNA, 19 bp, Artificial Sequence
  Description of Artificial Sequence: Synthetic primer
gagagaaagcccctcccct

SEQ ID NO: 1722 - DNA, 20 bp, Artificial Sequence
  Description of Artificial Sequence: Synthetic primer
acatcaccctcctttcccag

SEQ ID NO: 1723 - DNA, 20 bp, Artificial Sequence
  Description of Artificial Sequence: Synthetic primer
aatgacaatgctgtgccttc

SEQ ID NO: 1724 - DNA, 20 bp, Artificial Sequence
  Description of Artificial Sequence: Synthetic primer
atggagatgaccctcaggtg

SEQ ID NO: 1725 - DNA, 20 bp, Artificial Sequence
  Description of Artificial Sequence: Synthetic primer
attccaagggctatctccac

SEQ ID NO: 1726 - DNA, 20 bp, Artificial Sequence
  Description of Artificial Sequence: Synthetic primer
gcatcttgctatcttctccc

SEQ ID NO: 1727 - DNA, 19 bp, Artificial Sequence
  Description of Artificial Sequence: Synthetic primer
ctctgttgagatttttgac

SEQ ID NO: 1728 - DNA, 20 bp, Artificial Sequence
  Description of Artificial Sequence: Synthetic primer
gaatgaaatctgggggataa

SEQ ID NO: 1729 - DNA, 19 bp, Artificial Sequence
  Description of Artificial Sequence: Synthetic primer
gcctccaattattattcag

SEQ ID NO: 1730 - DNA, 19 bp, Artificial Sequence
  Description of Artificial Sequence: Synthetic primer
cttgaaggaagagtacttg

SEQ ID NO: 1731 - DNA, 20 bp, Artificial Sequence
  Description of Artificial Sequence: Synthetic primer
ctcagtttcttgggaaggat

SEQ ID NO: 1732 - DNA, 20 bp, Artificial Sequence
  Description of Artificial Sequence: Synthetic primer
attcagtaaacatttattcg

SEQ ID NO: 1733 - DNA, 20 bp, Artificial Sequence
  Description of Artificial Sequence: Synthetic primer
acccccatgattctaatgag

SEQ ID NO: 1734 - DNA, 20 bp, Artificial Sequence
  Description of Artificial Sequence: Synthetic primer
ggagaaatgaccaagagatg

SEQ ID NO: 1735 - DNA, 19 bp, Artificial Sequence
  Description of Artificial Sequence: Synthetic primer
tgaccaagagatgaaatac

SEQ ID NO: 1736 - DNA, 21 bp, Artificial Sequence
  Description of Artificial Sequence: Synthetic primer
gaacaacctctattatattac

SEQ ID NO: 1737 - DNA, 20 bp, Artificial Sequence
  Description of Artificial Sequence: Synthetic primer
tgtggtcagcactatcatgg

SEQ ID NO: 1738 - DNA, 19 bp, Artificial Sequence
  Description of Artificial Sequence: Synthetic primer
gattaaataccctacagtg

SEQ ID NO: 1739 - DNA, 20 bp, Artificial Sequence
  Description of Artificial Sequence: Synthetic primer
gctggatacctaattaatgc

SEQ ID NO: 1740 - DNA, 20 bp, Artificial Sequence
  Description of Artificial Sequence: Synthetic primer
gctggatacctaattaatgc

SEQ ID NO: 1741 - DNA, 21 bp, Artificial Sequence
  Description of Artificial Sequence: Synthetic primer
gtttatgttacactgcaaagc

SEQ ID NO: 1742 - DNA, 19 bp, Artificial Sequence
  Description of Artificial Sequence: Synthetic primer
tactaacagttcttttacc

SEQ ID NO: 1743 - DNA, 20 bp, Artificial Sequence
  Description of Artificial Sequence: Synthetic primer
gaaggtttggtcaatcctat

SEQ ID NO: 1744 - DNA, 20 bp, Artificial Sequence
  Description of Artificial Sequence: Synthetic primer
gaatacctattaccacaccc

SEQ ID NO: 1745 - DNA, 20 bp, Artificial Sequence
  Description of Artificial Sequence: Synthetic primer
tggctctttaagtgataggc

SEQ ID NO: 1746 - DNA, 19 bp, Artificial Sequence
  Description of Artificial Sequence: Synthetic primer
ctctgcaacaagacaactg

SEQ ID NO: 1747 - DNA, 19 bp, Artificial Sequence
  Description of Artificial Sequence: Synthetic primer
ccaatgatccatagtaatc

SEQ ID NO: 1748 - DNA, 20 bp, Artificial Sequence
  Description of Artificial Sequence: Synthetic primer
gtcattgtcacaaaaatcac

SEQ ID NO: 1749 - DNA, 20 bp, Artificial Sequence
  Description of Artificial Sequence: Synthetic primer
gttggaaccaacctcatttc

SEQ ID NO: 1750 - DNA, 20 bp, Artificial Sequence
  Description of Artificial Sequence: Synthetic primer
ggttgtttcagtattcccac

SEQ ID NO: 1751 - DNA, 20 bp, Artificial Sequence
  Description of Artificial Sequence: Synthetic primer
aaccttgctccctttacttc

SEQ ID NO: 1752 - DNA, 20 bp, Artificial Sequence
  Description of Artificial Sequence: Synthetic primer
tagaacagagcttatcacag

SEQ ID NO: 1753 - DNA, 20 bp, Artificial Sequence
  Description of Artificial Sequence: Synthetic primer
caatgctgatttggtccttc

SEQ ID NO: 1754 - DNA, 20 bp, Artificial Sequence
  Description of Artificial Sequence: Synthetic primer
taaaagcattggtgaacagc

SEQ ID NO: 1755 - DNA, 20 bp, Artificial Sequence
  Description of Artificial Sequence: Synthetic primer
tttcatcactggcaggacac

SEQ ID NO: 1756 - DNA, 20 bp, Artificial Sequence
  Description of Artificial Sequence: Synthetic primer
cattatatacatgatcaaca

SEQ ID NO: 1757 - DNA, 19 bp, Artificial Sequence
  Description of Artificial Sequence: Synthetic primer
agtgtataccttcagttac

SEQ ID NO: 1758 - DNA, 20 bp, Artificial Sequence
  Description of Artificial Sequence: Synthetic primer
atggcagtgctactttctac

SEQ ID NO: 1759 - DNA, 20 bp, Artificial Sequence
  Description of Artificial Sequence: Synthetic primer
tgcacttgctgaagtaactc

SEQ ID NO: 1760 - DNA, 20 bp, Artificial Sequence
  Description of Artificial Sequence: Synthetic primer
ttgtacactcttcaatctgg

SEQ ID NO: 1761 - DNA, 19 bp, Artificial Sequence
  Description of Artificial Sequence: Synthetic primer
tgtgtccacatatgtaatc

SEQ ID NO: 1762 - DNA, 20 bp, Artificial Sequence
  Description of Artificial Sequence: Synthetic primer
cttctccaggtctgtgaaac

SEQ ID NO: 1763 - DNA, 20 bp, Artificial Sequence
  Description of Artificial Sequence: Synthetic primer
tttcctatcttctccaggtc

SEQ ID NO: 1764 - DNA, 20 bp, Artificial Sequence
  Description of Artificial Sequence: Synthetic primer
cacagacctggagaagatag

SEQ ID NO: 1765 - DNA, 20 bp, Artificial Sequence
  Description of Artificial Sequence: Synthetic primer
cacagacctggagaagatag

SEQ ID NO: 1766 - DNA, 21 bp, Artificial Sequence
  Description of Artificial Sequence: Synthetic primer
ggaaattcaatagactaggag

SEQ ID NO: 1767 - DNA, 21 bp, Artificial Sequence
  Description of Artificial Sequence: Synthetic primer
ccttttcatgattcatctatc

SEQ ID NO: 1768 - DNA, 19 bp, Artificial Sequence
  Description of Artificial Sequence: Synthetic primer
ccactgtagaaagatgtaa

SEQ ID NO: 1769 - DNA, 20 bp, Artificial Sequence
  Description of Artificial Sequence: Synthetic primer
gaccaagctcctgaaagatg

SEQ ID NO: 1770 - DNA, 19 bp, Artificial Sequence
  Description of Artificial Sequence: Synthetic primer
gttgattgctacattgaag

SEQ ID NO: 1771 - DNA, 20 bp, Artificial Sequence
  Description of Artificial Sequence: Synthetic primer
tagactgcccctcttgtttg

SEQ ID NO: 1772 - DNA, 20 bp, Artificial Sequence
  Description of Artificial Sequence: Synthetic primer
ctctgtgggaaatgactatc

SEQ ID NO: 1773 - DNA, 21 bp, Artificial Sequence
  Description of Artificial Sequence: Synthetic primer
ctgatcatgtaatggcataag

SEQ ID NO: 1774 - DNA, 21 bp, Artificial Sequence
  Description of Artificial Sequence: Synthetic primer
cttatgccattacatgatcag

SEQ ID NO: 1775 - DNA, 20 bp, Artificial Sequence
  Description of Artificial Sequence: Synthetic primer
cagcatttttggtgctttgg

SEQ ID NO: 1776 - DNA, 20 bp, Artificial Sequence
  Description of Artificial Sequence: Synthetic primer
ccacagtaatgttagcaggg

SEQ ID NO: 1777 - DNA, 20 bp, Artificial Sequence
  Description of Artificial Sequence: Synthetic primer
gcagtagactgatgacagtg

SEQ ID NO: 1778 - DNA, 20 bp, Artificial Sequence
  Description of Artificial Sequence: Synthetic primer
gctattttggcactcaaggg

SEQ ID NO: 1779 - DNA, 20 bp, Artificial Sequence
  Description of Artificial Sequence: Synthetic primer
ctgggttctgttaatgcact

SEQ ID NO: 1780 - DNA, 20 bp, Artificial Sequence
  Description of Artificial Sequence: Synthetic primer
agctaatgaagagcactcgg

SEQ ID NO: 1781 - DNA, 19 bp, Artificial Sequence
  Description of Artificial Sequence: Synthetic primer
cccatattaatccaagaac

SEQ ID NO: 1782 - DNA, 20 bp, Artificial Sequence
  Description of Artificial Sequence: Synthetic primer
aaacaaatttggagcatggg

SEQ ID NO: 1783 - DNA, 20 bp, Artificial Sequence
  Description of Artificial Sequence: Synthetic primer
gaataatttcatagattagg

SEQ ID NO: 1784 - DNA, 19 bp, Artificial Sequence
  Description of Artificial Sequence: Synthetic primer
gtgtgtttaatagtatgcc

SEQ ID NO: 1785 - DNA, 20 bp, Artificial Sequence
  Description of Artificial Sequence: Synthetic primer
atcccactcttagcagtctc

SEQ ID NO: 1786 - DNA, 20 bp, Artificial Sequence
  Description of Artificial Sequence: Synthetic primer
gctttggtctctgccaaatc

SEQ ID NO: 1787 - DNA, 20 bp, Artificial Sequence
  Description of Artificial Sequence: Synthetic primer
catagtgttaagacattgtg

SEQ ID NO: 1788 - DNA, 20 bp, Artificial Sequence
  Description of Artificial Sequence: Synthetic primer
actctggcttggaaatgagg

SEQ ID NO: 1789 - DNA, 20 bp, Artificial Sequence
  Description of Artificial Sequence: Synthetic primer
tagagggcacttttgtggac

SEQ ID NO: 1790 - DNA, 20 bp, Artificial Sequence
  Description of Artificial Sequence: Synthetic primer
agggacctatttcttcaggg

SEQ ID NO: 1791 - DNA, 19 bp, Artificial Sequence
  Description of Artificial Sequence: Synthetic primer
gggtattcctagaaatgtg

SEQ ID NO: 1792 - DNA, 20 bp, Artificial Sequence
  Description of Artificial Sequence: Synthetic primer
tcaaccagaatctggttcac

SEQ ID NO: 1793 - DNA, 20 bp, Artificial Sequence
  Description of Artificial Sequence: Synthetic primer
tggtgaacaaactgtttgtg

SEQ ID NO: 1794 - DNA, 21 bp, Artificial Sequence
  Description of Artificial Sequence: Synthetic primer
gctgtgattatataaatactc

SEQ ID NO: 1795 - DNA, 20 bp, Artificial Sequence
  Description of Artificial Sequence: Synthetic primer
aggaacatgagaccaggaag

SEQ ID NO: 1796 - DNA, 21 bp, Artificial Sequence
  Description of Artificial Sequence: Synthetic primer
gggaagttttttgaagatggg

SEQ ID NO: 1797 - DNA, 19 bp, Artificial Sequence
  Description of Artificial Sequence: Synthetic primer
tctcccatcttcaaaaaac

SEQ ID NO: 1798 - DNA, 19 bp, Artificial Sequence
  Description of Artificial Sequence: Synthetic primer
aaagtggttcaactgaaag

SEQ ID NO: 1799 - DNA, 20 bp, Artificial Sequence
  Description of Artificial Sequence: Synthetic primer
gcttgggattcaagtcataa

SEQ ID NO: 1800 - DNA, 20 bp, Artificial Sequence
  Description of Artificial Sequence: Synthetic primer
gaaaggtaagacagacctag

SEQ ID NO: 1801 - DNA, 20 bp, Artificial Sequence
  Description of Artificial Sequence: Synthetic primer
agatgttcaatggacatccc

SEQ ID NO: 1802 - DNA, 19 bp, Artificial Sequence
  Description of Artificial Sequence: Synthetic primer
gtgaaatctcaggattcat

SEQ ID NO: 1803 - DNA, 20 bp, Artificial Sequence
  Description of Artificial Sequence: Synthetic primer
gctaaaagctttgagtgatg

SEQ ID NO: 1804 - DNA, 20 bp, Artificial Sequence
  Description of Artificial Sequence: Synthetic primer
caatgtccatgtctccttcc

SEQ ID NO: 1805 - DNA, 20 bp, Artificial Sequence
  Description of Artificial Sequence: Synthetic primer
aagtggattgtagctagttg

SEQ ID NO: 1806 - DNA, 20 bp, Artificial Sequence
  Description of Artificial Sequence: Synthetic primer
catggctagatctggtttcc

SEQ ID NO: 1807 - DNA, 20 bp, Artificial Sequence
  Description of Artificial Sequence: Synthetic primer
tcaaaagccattcaggcttc

SEQ ID NO: 1808 - DNA, 21 bp, Artificial Sequence
  Description of Artificial Sequence: Synthetic primer
gaagtagaaaggcaaataggg

SEQ ID NO: 1809 - DNA, 19 bp, Artificial Sequence
  Description of Artificial Sequence: Synthetic primer
gttggctcatgccactgtc

SEQ ID NO: 1810 - DNA, 19 bp, Artificial Sequence
  Description of Artificial Sequence: Synthetic primer
cccctatttgcctttctac

SEQ ID NO: 1811 - DNA, 20 bp, Artificial Sequence
  Description of Artificial Sequence: Synthetic primer
ctgaggtgactctgtgtttg

SEQ ID NO: 1812 - DNA, 20 bp, Artificial Sequence
  Description of Artificial Sequence: Synthetic primer
cctgaaagccacaggcattg

SEQ ID NO: 1813 - DNA, 20 bp, Artificial Sequence
  Description of Artificial Sequence: Synthetic primer
cctgtggctttcaggtcatt

SEQ ID NO: 1814 - DNA, 20 bp, Artificial Sequence
  Description of Artificial Sequence: Synthetic primer
cccattcagcttactaatga

SEQ ID NO: 1815 - DNA, 21 bp, Artificial Sequence
  Description of Artificial Sequence: Synthetic primer
gcagtcttacaaaacctaagc

SEQ ID NO: 1816 - DNA, 20 bp, Artificial Sequence
  Description of Artificial Sequence: Synthetic primer
tacaggaatgtaggaagatg

SEQ ID NO: 1817 - DNA, 20 bp, Artificial Sequence
  Description of Artificial Sequence: Synthetic primer
agtgagagtcaccaacatag

SEQ ID NO: 1818 - DNA, 20 bp, Artificial Sequence
  Description of Artificial Sequence: Synthetic primer
cctaggatttctggttcagc

SEQ ID NO: 1819 - DNA, 20 bp, Artificial Sequence
  Description of Artificial Sequence: Synthetic primer
cataggctgaaccagaaatc

SEQ ID NO: 1820 - DNA, 20 bp, Artificial Sequence
  Description of Artificial Sequence: Synthetic primer
cataggctgaaccagaaatc

SEQ ID NO: 1821 - DNA, 20 bp, Artificial Sequence
  Description of Artificial Sequence: Synthetic primer
cctgggaaaggagggattat

SEQ ID NO: 1822 - DNA, 20 bp, Artificial Sequence
  Description of Artificial Sequence: Synthetic primer
tctagccttgttagttgccc

SEQ ID NO: 1823 - DNA, 20 bp, Artificial Sequence
  Description of Artificial Sequence: Synthetic primer
ttggcattactcctgattcc

SEQ ID NO: 1824 - DNA, 20 bp, Artificial Sequence
  Description of Artificial Sequence: Synthetic primer
ggaggaatcaggagtaatgc

SEQ ID NO: 1825 - DNA, 20 bp, Artificial Sequence
  Description of Artificial Sequence: Synthetic primer
ctgtataggacagtatctgg

SEQ ID NO: 1826 - DNA, 20 bp, Artificial Sequence
  Description of Artificial Sequence: Synthetic primer
agtattccttaaaatatcac

SEQ ID NO: 1827 - DNA, 20 bp, Artificial Sequence
  Description of Artificial Sequence: Synthetic primer
ttaatgtaggtgcagttcag

SEQ ID NO: 1828 - DNA, 20 bp, Artificial Sequence
  Description of Artificial Sequence: Synthetic primer
cattactgaactgcacctac

SEQ ID NO: 1829 - DNA, 19 bp, Artificial Sequence
  Description of Artificial Sequence: Synthetic primer
gtcttatctacaaaccaaa

SEQ ID NO: 1830 - DNA, 20 bp, Artificial Sequence
  Description of Artificial Sequence: Synthetic primer
ccaggtattcttcaggttag

SEQ ID NO: 1831 - DNA, 20 bp, Artificial Sequence
  Description of Artificial Sequence: Synthetic primer
ctttttttaaactagcaggg

SEQ ID NO: 1832 - DNA, 20 bp, Artificial Sequence
  Description of Artificial Sequence: Synthetic primer
ggaagtagaaactgaagaac

SEQ ID NO: 1833 - DNA, 20 bp, Artificial Sequence
  Description of Artificial Sequence: Synthetic primer
aagctcctcaaaagagctgg

SEQ ID NO: 1834 - DNA, 20 bp, Artificial Sequence
  Description of Artificial Sequence: Synthetic primer
ttatctgttctcccctaccc

SEQ ID NO: 1835 - DNA, 20 bp, Artificial Sequence
  Description of Artificial Sequence: Synthetic primer
gtagtagtatgtgagtttgg

SEQ ID NO: 1836 - DNA, 20 bp, Artificial Sequence
  Description of Artificial Sequence: Synthetic primer
gatccaaactcacatactac

SEQ ID NO: 1837 - DNA, 20 bp, Artificial Sequence
  Description of Artificial Sequence: Synthetic primer
tgagaacagttccatagccc

SEQ ID NO: 1838 - DNA, 21 bp, Artificial Sequence
  Description of Artificial Sequence: Synthetic primer
gcgcagtgtttaatgaacttg

SEQ ID NO: 1839 - DNA, 20 bp, Artificial Sequence
  Description of Artificial Sequence: Synthetic primer
aagataactacctggcattc

SEQ ID NO: 1840 - DNA, 20 bp, Artificial Sequence
  Description of Artificial Sequence: Synthetic primer
tgaaatttacaagtaggggc

SEQ ID NO: 1841 - DNA, 20 bp, Artificial Sequence
  Description of Artificial Sequence: Synthetic primer
gtaaataatttttgcatgct

SEQ ID NO: 1842 - DNA, 20 bp, Artificial Sequence
  Description of Artificial Sequence: Synthetic primer
cctttccttttccctttatg

SEQ ID NO: 1843 - DNA, 18 bp, Artificial Sequence
  Description of Artificial Sequence: Synthetic primer
cgcccgcactccagagcc

SEQ ID NO: 1844 - DNA, 20 bp, Artificial Sequence
  Description of Artificial Sequence: Synthetic primer
accacactcaacatttcggg

SEQ ID NO: 1845 - DNA, 20 bp, Artificial Sequence
  Description of Artificial Sequence: Synthetic primer
gaaatcctcggcgctctttg

SEQ ID NO: 1846 - DNA, 20 bp, Artificial Sequence
  Description of Artificial Sequence: Synthetic primer
gcagccaaagtacaaagagc

SEQ ID NO: 1847 - DNA, 20 bp, Artificial Sequence
  Description of Artificial Sequence: Synthetic primer
cacattctgtgaccaaacgg

SEQ ID NO: 1848 - DNA, 20 bp, Artificial Sequence
  Description of Artificial Sequence: Synthetic primer
gctacacattaatactgacc

SEQ ID NO: 1849 - DNA, 20 bp, Artificial Sequence
  Description of Artificial Sequence: Synthetic primer
tgaaggcaggttcattgtgg

SEQ ID NO: 1850 - DNA, 20 bp, Artificial Sequence
  Description of Artificial Sequence: Synthetic primer
catctaaagcagcagagagg

SEQ ID NO: 1851 - DNA, 21 bp, Artificial Sequence
  Description of Artificial Sequence: Synthetic primer
gattagatgaaacaggcacac

SEQ ID NO: 1852 - DNA, 20 bp, Artificial Sequence
  Description of Artificial Sequence: Synthetic primer
tgcaagcaaaggacagtaag

SEQ ID NO: 1853 - DNA, 20 bp, Artificial Sequence
  Description of Artificial Sequence: Synthetic primer
aataaactggcactacaggg

SEQ ID NO: 1854 - DNA, 20 bp, Artificial Sequence
  Description of Artificial Sequence: Synthetic primer
agtactttacctttcaaggc

SEQ ID NO: 1855 - DNA, 20 bp, Artificial Sequence
  Description of Artificial Sequence: Synthetic primer
gtcttaaagagaagactgcc

SEQ ID NO: 1856 - DNA, 20 bp, Artificial Sequence
  Description of Artificial Sequence: Synthetic primer
taggcagtcttctctttaag

SEQ ID NO: 1857 - DNA, 20 bp, Artificial Sequence
  Description of Artificial Sequence: Synthetic primer
caaaaatggctagaaatgtc

SEQ ID NO: 1858 - DNA, 20 bp, Artificial Sequence
  Description of Artificial Sequence: Synthetic primer
aaagcttcttaagagctcag

SEQ ID NO: 1859 - DNA, 19 bp, Artificial Sequence
  Description of Artificial Sequence: Synthetic primer
aagattaccagagaaagag

SEQ ID NO: 1860 - DNA, 18 bp, Artificial Sequence
  Description of Artificial Sequence: Synthetic primer
aatttgggcactgtggtt

SEQ ID NO: 1861 - DNA, 19 bp, Artificial Sequence
  Description of Artificial Sequence: Synthetic primer
tgtcatgcataaatgatgg

SEQ ID NO: 1862 - DNA, 20 bp, Artificial Sequence
  Description of Artificial Sequence: Synthetic primer
gagtttcttgaatcaactgg

SEQ ID NO: 1863 - DNA, 19 bp, Artificial Sequence
  Description of Artificial Sequence: Synthetic primer
atatttgtgttggcatcag

SEQ ID NO: 1864 - DNA, 18 bp, Artificial Sequence
  Description of Artificial Sequence: Synthetic primer
aatcaggggagaaaacaa

SEQ ID NO: 1865 - DNA, 20 bp, Artificial Sequence
  Description of Artificial Sequence: Synthetic primer
cagcagacctcacaaaaata

SEQ ID NO: 1866 - DNA, 20 bp, Artificial Sequence
  Description of Artificial Sequence: Synthetic primer
gtctttttaaatgaggcctg

SEQ ID NO: 1867 - DNA, 20 bp, Artificial Sequence
  Description of Artificial Sequence: Synthetic primer
caggcctcatttaaaaagac

SEQ ID NO: 1868 - DNA, 19 bp, Artificial Sequence
  Description of Artificial Sequence: Synthetic primer
aggtagttctctaagttac

SEQ ID NO: 1869 - DNA, 20 bp, Artificial Sequence
  Description of Artificial Sequence: Synthetic primer
catgggcaaacataatttgg

SEQ ID NO: 1870 - DNA, 20 bp, Artificial Sequence
  Description of Artificial Sequence: Synthetic primer
ctcccattattactcttcag

SEQ ID NO: 1871 - DNA, 20 bp, Artificial Sequence
  Description of Artificial Sequence: Synthetic primer
gcaaagtacattcctttctg

SEQ ID NO: 1872 - DNA, 20 bp, Artificial Sequence
  Description of Artificial Sequence: Synthetic primer
ctttgcagctggtgagaagg

SEQ ID NO: 1873 - DNA, 20 bp, Artificial Sequence
  Description of Artificial Sequence: Synthetic primer
gaaaaactaaagtctaacag

SEQ ID NO: 1874 - DNA, 20 bp, Artificial Sequence
  Description of Artificial Sequence: Synthetic primer
tgttctagaaacagtgcctt

SEQ ID NO: 1875 - DNA, 20 bp, Artificial Sequence
  Description of Artificial Sequence: Synthetic primer
gttactcaaagctgtgcagg

SEQ ID NO: 1876 - DNA, 21 bp, Artificial Sequence
  Description of Artificial Sequence: Synthetic primer
ctcaagcttttaaaattgacc

SEQ ID NO: 1877 - DNA, 19 bp, Artificial Sequence
  Description of Artificial Sequence: Synthetic primer
cagggtcaattttaaaagc

SEQ ID NO: 1878 - DNA, 20 bp, Artificial Sequence
  Description of Artificial Sequence: Synthetic primer
tctttctccttctgagatgc

SEQ ID NO: 1879 - DNA, 19 bp, Artificial Sequence
  Description of Artificial Sequence: Synthetic primer
aaatattctgcttgaatcc

SEQ ID NO: 1880 - DNA, 19 bp, Artificial Sequence
  Description of Artificial Sequence: Synthetic primer
ggattcaagcagaatattt

SEQ ID NO: 1881 - DNA, 20 bp, Artificial Sequence
  Description of Artificial Sequence: Synthetic primer
ccaaagtaggtttttgtagc

SEQ ID NO: 1882 - DNA, 19 bp, Artificial Sequence
  Description of Artificial Sequence: Synthetic primer
tacagctacaaaaacctac

SEQ ID NO: 1883 - DNA, 21 bp, Artificial Sequence
  Description of Artificial Sequence: Synthetic primer
cagtgaatattttgctgaagg

SEQ ID NO: 1884 - DNA, 20 bp, Artificial Sequence
  Description of Artificial Sequence: Synthetic primer
tgcatttagaagcttacctg

SEQ ID NO: 1885 - DNA, 19 bp, Artificial Sequence
  Description of Artificial Sequence: Synthetic primer
tagtaaatttccatctgtg

SEQ ID NO: 1886 - DNA, 19 bp, Artificial Sequence
  Description of Artificial Sequence: Synthetic primer
gtaaaacattatacagctc

SEQ ID NO: 1887 - DNA, 19 bp, Artificial Sequence
  Description of Artificial Sequence: Synthetic primer
tgcatcaagcatctgagaa

SEQ ID NO: 1888 - DNA, 21 bp, Artificial Sequence
  Description of Artificial Sequence: Synthetic primer
ccataagttttaggctgtacc

SEQ ID NO: 1889 - DNA, 19 bp, Artificial Sequence
  Description of Artificial Sequence: Synthetic primer
ccattgtgtgtataatgtt

SEQ ID NO: 1890 - DNA, 20 bp, Artificial Sequence
  Description of Artificial Sequence: Synthetic primer
catatttgtctgtgtacttg

SEQ ID NO: 1891 - DNA, 20 bp, Artificial Sequence
  Description of Artificial Sequence: Synthetic primer
acaaatattgacaggcagca

SEQ ID NO: 1892 - DNA, 19 bp, Artificial Sequence
  Description of Artificial Sequence: Synthetic primer
ttcccaccaggtttcaggc

SEQ ID NO: 1893 - DNA, 19 bp, Artificial Sequence
  Description of Artificial Sequence: Synthetic primer
ggaagttaattgggaataa

SEQ ID NO: 1894 - DNA, 19 bp, Artificial Sequence
  Description of Artificial Sequence: Synthetic primer
gatgtgaataaacacaagc

SEQ ID NO: 1895 - DNA, 19 bp, Artificial Sequence
  Description of Artificial Sequence: Synthetic primer
atgttcaaaaatggtctga

SEQ ID NO: 1896 - DNA, 21 bp, Artificial Sequence
  Description of Artificial Sequence: Synthetic primer
gaacagctatatttcaaaccc

SEQ ID NO: 1897 - DNA, 21 bp, Artificial Sequence
  Description of Artificial Sequence: Synthetic primer
gggtttgaaatatagctgttc

SEQ ID NO: 1898 - DNA, 20 bp, Artificial Sequence
  Description of Artificial Sequence: Synthetic primer
actgcattctttagtgtagc

SEQ ID NO: 1899 - DNA, 20 bp, Artificial Sequence
  Description of Artificial Sequence: Synthetic primer
gtagactgtttaatgactgg

SEQ ID NO: 1900 - DNA, 20 bp, Artificial Sequence
  Description of Artificial Sequence: Synthetic primer
ctgagttccttcagagtgtc

SEQ ID NO: 1901 - DNA, 20 bp, Artificial Sequence
  Description of Artificial Sequence: Synthetic primer
acactctgaaggaactcagg

SEQ ID NO: 1902 - DNA, 20 bp, Artificial Sequence
  Description of Artificial Sequence: Synthetic primer
agacattgatgccagctcag

SEQ ID NO: 1903 - DNA, 20 bp, Artificial Sequence
  Description of Artificial Sequence: Synthetic primer
gtatcatggagttggagaag

SEQ ID NO: 1904 - DNA, 18 bp, Artificial Sequence
  Description of Artificial Sequence: Synthetic primer
tgaaagaacatggtgttg

SEQ ID NO: 1905 - DNA, 19 bp, Artificial Sequence
  Description of Artificial Sequence: Synthetic primer
gggctgagcatcccatcct

SEQ ID NO: 1906 - DNA, 21 bp, Artificial Sequence
  Description of Artificial Sequence: Synthetic primer
gaaaagaaagagcagttacac

SEQ ID NO: 1907 - DNA, 20 bp, Artificial Sequence
  Description of Artificial Sequence: Synthetic primer
acagttggaacaggtgtttg

SEQ ID NO: 1908 - DNA, 20 bp, Artificial Sequence
  Description of Artificial Sequence: Synthetic primer
atcggtacagttgaaatggg

SEQ ID NO: 1909 - DNA, 20 bp, Artificial Sequence
  Description of Artificial Sequence: Synthetic primer
ggaattggttataacacccg

SEQ ID NO: 1910 - DNA, 18 bp, Artificial Sequence
  Description of Artificial Sequence: Synthetic primer
gaagtcgcttgccaaggg

SEQ ID NO: 1911 - DNA, 19 bp, Artificial Sequence
  Description of Artificial Sequence: Synthetic primer
ggctatgaagaatgtattg

SEQ ID NO: 1912 - DNA, 20 bp, Artificial Sequence
  Description of Artificial Sequence: Synthetic primer
aggagctaagagcccaaatc

SEQ ID NO: 1913 - DNA, 20 bp, Artificial Sequence
  Description of Artificial Sequence: Synthetic primer
gctcttagctccttcttctc

SEQ ID NO: 1914 - DNA, 20 bp, Artificial Sequence
  Description of Artificial Sequence: Synthetic primer
tgaggtctgttttttctggc

SEQ ID NO: 1915 - DNA, 19 bp, Artificial Sequence
  Description of Artificial Sequence: Synthetic primer
tcagactcttcatggaaac

SEQ ID NO: 1916 - DNA, 21 bp, Artificial Sequence
  Description of Artificial Sequence: Synthetic primer
gaagataaaataacagtccac

SEQ ID NO: 1917 - DNA, 20 bp, Artificial Sequence
  Description of Artificial Sequence: Synthetic primer
attattttcaaccacaacat

SEQ ID NO: 1918 - DNA, 20 bp, Artificial Sequence
  Description of Artificial Sequence: Synthetic primer
ggaatgttccacctttctac

SEQ ID NO: 1919 - DNA, 19 bp, Artificial Sequence
  Description of Artificial Sequence: Synthetic primer
gaaactgaagtcattcatt

SEQ ID NO: 1920 - DNA, 20 bp, Artificial Sequence
  Description of Artificial Sequence: Synthetic primer
cagtcctcaagttcaccaag

SEQ ID NO: 1921 - DNA, 20 bp, Artificial Sequence
  Description of Artificial Sequence: Synthetic primer
tgcactttccagacaagcag

SEQ ID NO: 1922 - DNA, 20 bp, Artificial Sequence
  Description of Artificial Sequence: Synthetic primer
aaaggtctgcaaggaaccac

SEQ ID NO: 1923 - DNA, 20 bp, Artificial Sequence
  Description of Artificial Sequence: Synthetic primer
ctgtgtcaatggcacatctg

SEQ ID NO: 1924 - DNA, 20 bp, Artificial Sequence
  Description of Artificial Sequence: Synthetic primer
gtaattcagatgtgccattg

SEQ ID NO: 1925 - DNA, 20 bp, Artificial Sequence
  Description of Artificial Sequence: Synthetic primer
attcatttaatctggcaatt

SEQ ID NO: 1926 - DNA, 18 bp, Artificial Sequence
  Description of Artificial Sequence: Synthetic primer
tcttatttcctggaacca

SEQ ID NO: 1927 - DNA, 19 bp, Artificial Sequence
  Description of Artificial Sequence: Synthetic primer
tgaggtgtgtctggctgtc

SEQ ID NO: 1928 - DNA, 20 bp, Artificial Sequence
  Description of Artificial Sequence: Synthetic primer
aaggcggaagaggtgggatg

SEQ ID NO: 1929 - DNA, 20 bp, Artificial Sequence
  Description of Artificial Sequence: Synthetic primer
aaaggtgagccaatggggta

SEQ ID NO: 1930 - DNA, 20 bp, Artificial Sequence
  Description of Artificial Sequence: Synthetic primer
accccattggctcacctttc

SEQ ID NO: 1931 - DNA, 20 bp, Artificial Sequence
  Description of Artificial Sequence: Synthetic primer
tctgccttacgaccaaaagc

SEQ ID NO: 1932 - DNA, 19 bp, Artificial Sequence
  Description of Artificial Sequence: Synthetic primer
aggcggatgagtgaggcag

SEQ ID NO: 1933 - DNA, 19 bp, Artificial Sequence
  Description of Artificial Sequence: Synthetic primer
tgagctattgtccctccag

SEQ ID NO: 1934 - DNA, 19 bp, Artificial Sequence
  Description of Artificial Sequence: Synthetic primer
gtttaatttactggtgccc

SEQ ID NO: 1935 - DNA, 19 bp, Artificial Sequence
  Description of Artificial Sequence: Synthetic primer
atctcatctccaattttac

SEQ ID NO: 1936 - DNA, 21 bp, Artificial Sequence
  Description of Artificial Sequence: Synthetic primer
cagctttgattcttaaacccc

SEQ ID NO: 1937 - DNA, 20 bp, Artificial Sequence
  Description of Artificial Sequence: Synthetic primer
cttcctgtgaacctgctttc

SEQ ID NO: 1938 - DNA, 20 bp, Artificial Sequence
  Description of Artificial Sequence: Synthetic primer
cttcaaggcaatctttctcc

SEQ ID NO: 1939 - DNA, 20 bp, Artificial Sequence
  Description of Artificial Sequence: Synthetic primer
gcaggttcacaggaagtttc

SEQ ID NO: 1940 - DNA, 20 bp, Artificial Sequence
  Description of Artificial Sequence: Synthetic primer
cttcaaggcaatctttctcc

SEQ ID NO: 1941 - DNA, 21 bp, Artificial Sequence
  Description of Artificial Sequence: Synthetic primer
ctccacttgtgctctttattc

SEQ ID NO: 1942 - DNA, 21 bp, Artificial Sequence
  Description of Artificial Sequence: Synthetic primer
ctccacttgtgctctttattc

SEQ ID NO: 1943 - DNA, 21 bp, Artificial Sequence
  Description of Artificial Sequence: Synthetic primer
gcaggcttcaggataattatg

SEQ ID NO: 1944 - DNA, 19 bp, Artificial Sequence
  Description of Artificial Sequence: Synthetic primer
atggaaaagggatgcaaag

SEQ ID NO: 1945 - DNA, 20 bp, Artificial Sequence
  Description of Artificial Sequence: Synthetic primer
gaggatagtcttccctgatg

SEQ ID NO: 1946 - DNA, 20 bp, Artificial Sequence
  Description of Artificial Sequence: Synthetic primer
ctaaagtccagttcctcctc

SEQ ID NO: 1947 - DNA, 20 bp, Artificial Sequence
  Description of Artificial Sequence: Synthetic primer
gccagccaactcttgaaatg

SEQ ID NO: 1948 - DNA, 20 bp, Artificial Sequence
  Description of Artificial Sequence: Synthetic primer
gacaatgacacgtacatccc

SEQ ID NO: 1949 - DNA, 20 bp, Artificial Sequence
  Description of Artificial Sequence: Synthetic primer
gctttgcattctcccatctg

SEQ ID NO: 1950 - DNA, 20 bp, Artificial Sequence
  Description of Artificial Sequence: Synthetic primer
atatcctggggatggatgtg

SEQ ID NO: 1951 - DNA, 20 bp, Artificial Sequence
  Description of Artificial Sequence: Synthetic primer
cctacatttgcattggcctc

SEQ ID NO: 1952 - DNA, 20 bp, Artificial Sequence
  Description of Artificial Sequence: Synthetic primer
accagctacatctagattac

SEQ ID NO: 1953 - DNA, 20 bp, Artificial Sequence
  Description of Artificial Sequence: Synthetic primer
gaggccaatgcaaatgtagg

SEQ ID NO: 1954 - DNA, 18 bp, Artificial Sequence
  Description of Artificial Sequence: Synthetic primer
gagagcagggacatacgc

SEQ ID NO: 1955 - DNA, 20 bp, Artificial Sequence
  Description of Artificial Sequence: Synthetic primer
actagtctcactggcagtgg

SEQ ID NO: 1956 - DNA, 19 bp, Artificial Sequence
  Description of Artificial Sequence: Synthetic primer
gcctcccttctaccctctg

SEQ ID NO: 1957 - DNA, 20 bp, Artificial Sequence
  Description of Artificial Sequence: Synthetic primer
gtccactgccagtgagacta

SEQ ID NO: 1958 - DNA, 20 bp, Artificial Sequence
  Description of Artificial Sequence: Synthetic primer
tgccagtgagactagtgagc

SEQ ID NO: 1959 - DNA, 20 bp, Artificial Sequence
  Description of Artificial Sequence: Synthetic primer
ggactgactccactggtaat

SEQ ID NO: 1960 - DNA, 20 bp, Artificial Sequence
  Description of Artificial Sequence: Synthetic primer
attagttggagagagtggga

SEQ ID NO: 1961 - DNA, 20 bp, Artificial Sequence
  Description of Artificial Sequence: Synthetic primer
tttctataccccacctattc

SEQ ID NO: 1962 - DNA, 20 bp, Artificial Sequence
  Description of Artificial Sequence: Synthetic primer
ttggagagagtgggagatag

SEQ ID NO: 1963 - DNA, 19 bp, Artificial Sequence
  Description of Artificial Sequence: Synthetic primer
aagtatttgttcctcatgg

SEQ ID NO: 1964 - DNA, 20 bp, Artificial Sequence
  Description of Artificial Sequence: Synthetic primer
caaaaacaaaagcaagggac

SEQ ID NO: 1965 - DNA, 20 bp, Artificial Sequence
  Description of Artificial Sequence: Synthetic primer
atgtgcagaaggatggagtg

SEQ ID NO: 1966 - DNA, 20 bp, Artificial Sequence
  Description of Artificial Sequence: Synthetic primer
atccccactccatccttctg

SEQ ID NO: 1967 - DNA, 19 bp, Artificial Sequence
  Description of Artificial Sequence: Synthetic primer
aggacctgttctacaagta

SEQ ID NO: 1968 - DNA, 20 bp, Artificial Sequence
  Description of Artificial Sequence: Synthetic primer
ctgtgctagagaatgacttg

SEQ ID NO: 1969 - DNA, 20 bp, Artificial Sequence
  Description of Artificial Sequence: Synthetic primer
ccaatggttagtcagcaaag

SEQ ID NO: 1970 - DNA, 20 bp, Artificial Sequence
  Description of Artificial Sequence: Synthetic primer
agggactctaggaatttcag

SEQ ID NO: 1971 - DNA, 20 bp, Artificial Sequence
  Description of Artificial Sequence: Synthetic primer
ctaaccaatggttagtcagc

SEQ ID NO: 1972 - DNA, 20 bp, Artificial Sequence
  Description of Artificial Sequence: Synthetic primer
ctgactaaccattggttagg

SEQ ID NO: 1973 - DNA, 18 bp, Artificial Sequence
  Description of Artificial Sequence: Synthetic primer
agtcccacaggcgcctac

SEQ ID NO: 1974 - DNA, 19 bp, Artificial Sequence
  Description of Artificial Sequence: Synthetic primer
cttatttggtgtgctgttg

SEQ ID NO: 1975 - DNA, 20 bp, Artificial Sequence
  Description of Artificial Sequence: Synthetic primer
agtcccacaggcgcctacct

SEQ ID NO: 1976 - DNA, 20 bp, Artificial Sequence
  Description of Artificial Sequence: Synthetic primer
atgcacacttatgctgacgg

SEQ ID NO: 1977 - DNA, 20 bp, Artificial Sequence
  Description of Artificial Sequence: Synthetic primer
ctctaacataaaccctgctg

SEQ ID NO: 1978 - DNA, 20 bp, Artificial Sequence
  Description of Artificial Sequence: Synthetic primer
cagttaccttctagtaggtc

SEQ ID NO: 1979 - DNA, 20 bp, Artificial Sequence
  Description of Artificial Sequence: Synthetic primer
gtaattgatgttgggtatgc

SEQ ID NO: 1980 - DNA, 20 bp, Artificial Sequence
  Description of Artificial Sequence: Synthetic primer
cccaataagagtccctgaag

SEQ ID NO: 1981 - DNA, 19 bp, Artificial Sequence
  Description of Artificial Sequence: Synthetic primer
atcctatgtatcttattcc

SEQ ID NO: 1982 - DNA, 20 bp, Artificial Sequence
  Description of Artificial Sequence: Synthetic primer
gcttttctatattccccagc

SEQ ID NO: 1983 - DNA, 20 bp, Artificial Sequence
  Description of Artificial Sequence: Synthetic primer
tagtccctcctagctcaacc

SEQ ID NO: 1984 - DNA, 20 bp, Artificial Sequence
  Description of Artificial Sequence: Synthetic primer
tggagcactgcagagaagtc

SEQ ID NO: 1985 - DNA, 19 bp, Artificial Sequence
  Description of Artificial Sequence: Synthetic primer
ctgcaaaggcacagagact

SEQ ID NO: 1986 - DNA, 20 bp, Artificial Sequence
  Description of Artificial Sequence: Synthetic primer
ccagtattttgaaacagagg

SEQ ID NO: 1987 - DNA, 20 bp, Artificial Sequence
  Description of Artificial Sequence: Synthetic primer
cttatcctttgggtcttctc

SEQ ID NO: 1988 - DNA, 20 bp, Artificial Sequence
  Description of Artificial Sequence: Synthetic primer
gccatatccaaaccacattg

SEQ ID NO: 1989 - DNA, 20 bp, Artificial Sequence
  Description of Artificial Sequence: Synthetic primer
gatcttccaggctgaaagtg

SEQ ID NO: 1990 - DNA, 20 bp, Artificial Sequence
  Description of Artificial Sequence: Synthetic primer
atgctgatgaaccgcacttc

SEQ ID NO: 1991 - DNA, 20 bp, Artificial Sequence
  Description of Artificial Sequence: Synthetic primer
atttgtgaggtggaaggtgg

SEQ ID NO: 1992 - DNA, 20 bp, Artificial Sequence
  Description of Artificial Sequence: Synthetic primer
tgatcagagggatgagcttg

SEQ ID NO: 1993 - DNA, 19 bp, Artificial Sequence
  Description of Artificial Sequence: Synthetic primer
gtcacatcaaaatttggag

SEQ ID NO: 1994 - DNA, 20 bp, Artificial Sequence
  Description of Artificial Sequence: Synthetic primer
agcactctaaaaggatgcac

SEQ ID NO: 1995 - DNA, 20 bp, Artificial Sequence
  Description of Artificial Sequence: Synthetic primer
tgcatgaccaagatcagcag

SEQ ID NO: 1996 - DNA, 20 bp, Artificial Sequence
  Description of Artificial Sequence: Synthetic primer
gaaccccaacagcatccaag

SEQ ID NO: 1997 - DNA, 20 bp, Artificial Sequence
  Description of Artificial Sequence: Synthetic primer
gcaatttttccaagacaggc

SEQ ID NO: 1998 - DNA, 20 bp, Artificial Sequence
  Description of Artificial Sequence: Synthetic primer
cttctaggacttgtctattg

SEQ ID NO: 1999 - DNA, 20 bp, Artificial Sequence
  Description of Artificial Sequence: Synthetic primer
taactgtaaattctgaatac

SEQ ID NO: 2000 - DNA, 21 bp, Artificial Sequence
  Description of Artificial Sequence: Synthetic primer
cttgattgcccatgtaaatct

SEQ ID NO: 2001 - DNA, 20 bp, Artificial Sequence
  Description of Artificial Sequence: Synthetic primer
gcccatgtaaatcttgattg

SEQ ID NO: 2002 - DNA, 20 bp, Artificial Sequence
  Description of Artificial Sequence: Synthetic primer
gtggaaaaactggagtaaac

SEQ ID NO: 2003 - DNA, 20 bp, Artificial Sequence
  Description of Artificial Sequence: Synthetic primer
accggggactgtcttttttc

SEQ ID NO: 2004 - DNA, 19 bp, Artificial Sequence
  Description of Artificial Sequence: Synthetic primer
tccagctgcggagctctac

SEQ ID NO: 2005 - DNA, 20 bp, Artificial Sequence
  Description of Artificial Sequence: Synthetic primer
agaactggtaccagctagaa

SEQ ID NO: 2006 - DNA, 20 bp, Artificial Sequence
  Description of Artificial Sequence: Synthetic primer
agcttcgtgtcgtagatgtg

SEQ ID NO: 2007 - DNA, 20 bp, Artificial Sequence
  Description of Artificial Sequence: Synthetic primer
gctgcattctacctcccaaa

SEQ ID NO: 2008 - DNA, 20 bp, Artificial Sequence
  Description of Artificial Sequence: Synthetic primer
cttcagcaatcaaacaaagc

SEQ ID NO: 2009 - DNA, 20 bp, Artificial Sequence
  Description of Artificial Sequence: Synthetic primer
agcagaattgatgcaactac

SEQ ID NO: 2010 - DNA, 20 bp, Artificial Sequence
  Description of Artificial Sequence: Synthetic primer
gagacaacccaagttagatg

SEQ ID NO: 2011 - DNA, 20 bp, Artificial Sequence
  Description of Artificial Sequence: Synthetic primer
ctagctactttaaaaggaac

SEQ ID NO: 2012 - DNA, 20 bp, Artificial Sequence
  Description of Artificial Sequence: Synthetic primer
caacccaagttagatggagc

SEQ ID NO: 2013 - DNA, 20 bp, Artificial Sequence
  Description of Artificial Sequence: Synthetic primer
tcctctgcttcatctaactc

SEQ ID NO: 2014 - DNA, 19 bp, Artificial Sequence
  Description of Artificial Sequence: Synthetic primer
atgttcattccttcaactg

SEQ ID NO: 2015 - DNA, 19 bp, Artificial Sequence
  Description of Artificial Sequence: Synthetic primer
ctgatgatgggaaagaaca

SEQ ID NO: 2016 - DNA, 20 bp, Artificial Sequence
  Description of Artificial Sequence: Synthetic primer
ttgatccctttgccaagttc

SEQ ID NO: 2017 - DNA, 20 bp, Artificial Sequence
  Description of Artificial Sequence: Synthetic primer
aatggtgggacacagaagag

SEQ ID NO: 2018 - DNA, 20 bp, Artificial Sequence
  Description of Artificial Sequence: Synthetic primer
cttctgtgtcccaccattag

SEQ ID NO: 2019 - DNA, 20 bp, Artificial Sequence
  Description of Artificial Sequence: Synthetic primer
gagtcacattccaattcagc

SEQ ID NO: 2020 - DNA, 19 bp, Artificial Sequence
  Description of Artificial Sequence: Synthetic primer
gttcagtacttgaccattg

SEQ ID NO: 2021 - DNA, 20 bp, Artificial Sequence
  Description of Artificial Sequence: Synthetic primer
caaaagcttcaatggtcaag

SEQ ID NO: 2022 - DNA, 19 bp, Artificial Sequence
  Description of Artificial Sequence: Synthetic primer
atataaaaggaacttgtgc

SEQ ID NO: 2023 - DNA, 19 bp, Artificial Sequence
  Description of Artificial Sequence: Synthetic primer
ctccttttcatcaccagaa

SEQ ID NO: 2024 - DNA, 20 bp, Artificial Sequence
  Description of Artificial Sequence: Synthetic primer
gcaaaccacaactgcttctg

SEQ ID NO: 2025 - DNA, 20 bp, Artificial Sequence
  Description of Artificial Sequence: Synthetic primer
tctagcttttaacctaccag

SEQ ID NO: 2026 - DNA, 20 bp, Artificial Sequence
  Description of Artificial Sequence: Synthetic primer
ctaccagttatgcacctagc

SEQ ID NO: 2027 - DNA, 21 bp, Artificial Sequence
  Description of Artificial Sequence: Synthetic primer
gcttactaaagaactatggtg

SEQ ID NO: 2028 - DNA, 20 bp, Artificial Sequence
  Description of Artificial Sequence: Synthetic primer
ggcaaggatggagagtattc

SEQ ID NO: 2029 - DNA, 19 bp, Artificial Sequence
  Description of Artificial Sequence: Synthetic primer
aaattgtctggaggcccat

SEQ ID NO: 2030 - DNA, 20 bp, Artificial Sequence
  Description of Artificial Sequence: Synthetic primer
gtgcatgacaatgctcactg

SEQ ID NO: 2031 - DNA, 20 bp, Artificial Sequence
  Description of Artificial Sequence: Synthetic primer
cccatggccaatatcaacag

SEQ ID NO: 2032 - DNA, 20 bp, Artificial Sequence
  Description of Artificial Sequence: Synthetic primer
gctaaaggaagcattttggg

SEQ ID NO: 2033 - DNA, 20 bp, Artificial Sequence
  Description of Artificial Sequence: Synthetic primer
gctaaaggaagcattttggg

SEQ ID NO: 2034 - DNA, 20 bp, Artificial Sequence
  Description of Artificial Sequence: Synthetic primer
tccccagacaagggagaagt

SEQ ID NO: 2035 - DNA, 19 bp, Artificial Sequence
  Description of Artificial Sequence: Synthetic primer
attggaacagtatgtcttc

SEQ ID NO: 2036 - DNA, 21 bp, Artificial Sequence
  Description of Artificial Sequence: Synthetic primer
aataaatgtaatgaatatgtc

SEQ ID NO: 2037 - DNA, 20 bp, Artificial Sequence
  Description of Artificial Sequence: Synthetic primer
ttggtgtcctactttcctag

SEQ ID NO: 2038 - DNA, 20 bp, Artificial Sequence
  Description of Artificial Sequence: Synthetic primer
gactcatggcccaagttttg

SEQ ID NO: 2039 - DNA, 21 bp, Artificial Sequence
  Description of Artificial Sequence: Synthetic primer
caagttttggacagaaatatg

SEQ ID NO: 2040 - DNA, 20 bp, Artificial Sequence
  Description of Artificial Sequence: Synthetic primer
ctggacttttagaggcatgg

SEQ ID NO: 2041 - DNA, 20 bp, Artificial Sequence
  Description of Artificial Sequence: Synthetic primer
ggcctcatacatgacatctc

SEQ ID NO: 2042 - DNA, 20 bp, Artificial Sequence
  Description of Artificial Sequence: Synthetic primer
tgtatgaggccctgtagatg

SEQ ID NO: 2043 - DNA, 20 bp, Artificial Sequence
  Description of Artificial Sequence: Synthetic primer
ttagtgggaggaggtttgtg

SEQ ID NO: 2044 - DNA, 20 bp, Artificial Sequence
  Description of Artificial Sequence: Synthetic primer
agatgcacacaaacctcctc

SEQ ID NO: 2045 - DNA, 20 bp, Artificial Sequence
  Description of Artificial Sequence: Synthetic primer
tttatccctgcaggcgcata

SEQ ID NO: 2046 - DNA, 21 bp, Artificial Sequence
  Description of Artificial Sequence: Synthetic primer
gatttgtatgaacaaatgccc

SEQ ID NO: 2047 - DNA, 20 bp, Artificial Sequence
  Description of Artificial Sequence: Synthetic primer
atggaaacatccttctgcgg

SEQ ID NO: 2048 - DNA, 21 bp, Artificial Sequence
  Description of Artificial Sequence: Synthetic primer
gatttgtatgaacaaatgccc

SEQ ID NO: 2049 - DNA, 20 bp, Artificial Sequence
  Description of Artificial Sequence: Synthetic primer
agccaccattagctgagaac

SEQ ID NO: 2050 - DNA, 20 bp, Artificial Sequence
  Description of Artificial Sequence: Synthetic primer
agccaccattagctgagaac

SEQ ID NO: 2051 - DNA, 20 bp, Artificial Sequence
  Description of Artificial Sequence: Synthetic primer
tgcatggggaggtcaagcag

SEQ ID NO: 2052 - DNA, 20 bp, Artificial Sequence
  Description of Artificial Sequence: Synthetic primer
ctcatctgcaacatagcaca

SEQ ID NO: 2053 - DNA, 20 bp, Artificial Sequence
  Description of Artificial Sequence: Synthetic primer
tgcaacatagcacatgacag

SEQ ID NO: 2054 - DNA, 20 bp, Artificial Sequence
  Description of Artificial Sequence: Synthetic primer
agttgaccatcccgtatagc

SEQ ID NO: 2055 - DNA, 20 bp, Artificial Sequence
  Description of Artificial Sequence: Synthetic primer
cagatgatgttccgacacag

SEQ ID NO: 2056 - DNA, 20 bp, Artificial Sequence
  Description of Artificial Sequence: Synthetic primer
tagagtggtctgcgcagata

SEQ ID NO: 2057 - DNA, 20 bp, Artificial Sequence
  Description of Artificial Sequence: Synthetic primer
atttcttatctgcgcagacc

SEQ ID NO: 2058 - DNA, 20 bp, Artificial Sequence
  Description of Artificial Sequence: Synthetic primer
ctgttgtgaccagcattctg

SEQ ID NO: 2059 - DNA, 19 bp, Artificial Sequence
  Description of Artificial Sequence: Synthetic primer
tgaaatgatgagaagctgg

SEQ ID NO: 2060 - DNA, 20 bp, Artificial Sequence
  Description of Artificial Sequence: Synthetic primer
acacattgtgtaagttagag

SEQ ID NO: 2061 - DNA, 20 bp, Artificial Sequence
  Description of Artificial Sequence: Synthetic primer
cagctgttggcttacttacc

SEQ ID NO: 2062 - DNA, 19 bp, Artificial Sequence
  Description of Artificial Sequence: Synthetic primer
attaatactgctacgcaag

SEQ ID NO: 2063 - DNA, 20 bp, Artificial Sequence
  Description of Artificial Sequence: Synthetic primer
gaagactcagcacagatacc

SEQ ID NO: 2064 - DNA, 20 bp, Artificial Sequence
  Description of Artificial Sequence: Synthetic primer
tcctatcttcacatgggatg

SEQ ID NO: 2065 - DNA, 20 bp, Artificial Sequence
  Description of Artificial Sequence: Synthetic primer
ctcctatccctaacaacagc

SEQ ID NO: 2066 - DNA, 20 bp, Artificial Sequence
  Description of Artificial Sequence: Synthetic primer
ctgggcaactgtgaaaagac

SEQ ID NO: 2067 - DNA, 20 bp, Artificial Sequence
  Description of Artificial Sequence: Synthetic primer
agagacccaggagaacaatg

SEQ ID NO: 2068 - DNA, 19 bp, Artificial Sequence
  Description of Artificial Sequence: Synthetic primer
gaaggatactggaaaatag

SEQ ID NO: 2069 - DNA, 21 bp, Artificial Sequence
  Description of Artificial Sequence: Synthetic primer
gaggacaatactattttccag

SEQ ID NO: 2070 - DNA, 20 bp, Artificial Sequence
  Description of Artificial Sequence: Synthetic primer
caaatcagagagcaccacag

SEQ ID NO: 2071 - DNA, 20 bp, Artificial Sequence
  Description of Artificial Sequence: Synthetic primer
ataaactggtctgcagtggg

SEQ ID NO: 2072 - DNA, 20 bp, Artificial Sequence
  Description of Artificial Sequence: Synthetic primer
tagatggtggaagggaagac

SEQ ID NO: 2073 - DNA, 20 bp, Artificial Sequence
  Description of Artificial Sequence: Synthetic primer
gcatcatcccacttacacac

SEQ ID NO: 2074 - DNA, 20 bp, Artificial Sequence
  Description of Artificial Sequence: Synthetic primer
gctagtgtgaccaggaatat

SEQ ID NO: 2075 - DNA, 20 bp, Artificial Sequence
  Description of Artificial Sequence: Synthetic primer
tgtcccagaaatgtcattac

SEQ ID NO: 2076 - DNA, 20 bp, Artificial Sequence
  Description of Artificial Sequence: Synthetic primer
tcaaagtctaccatcagagc

SEQ ID NO: 2077 - DNA, 20 bp, Artificial Sequence
  Description of Artificial Sequence: Synthetic primer
acttggtctcctgtgattcc

SEQ ID NO: 2078 - DNA, 20 bp, Artificial Sequence
  Description of Artificial Sequence: Synthetic primer
tcctatggcccatgcaaatg

SEQ ID NO: 2079 - DNA, 20 bp, Artificial Sequence
  Description of Artificial Sequence: Synthetic primer
cctgtatgaaattgaaaggg

SEQ ID NO: 2080 - DNA, 20 bp, Artificial Sequence
  Description of Artificial Sequence: Synthetic primer
cttgagtgacaacatcaccc

SEQ ID NO: 2081 - DNA, 20 bp, Artificial Sequence
  Description of Artificial Sequence: Synthetic primer
gatttctcttcatggagccc

SEQ ID NO: 2082 - DNA, 20 bp, Artificial Sequence
  Description of Artificial Sequence: Synthetic primer
ttctcctctttgctgagcac

SEQ ID NO: 2083 - DNA, 20 bp, Artificial Sequence
  Description of Artificial Sequence: Synthetic primer
cagcaaagaggagaactcac

SEQ ID NO: 2084 - DNA, 20 bp, Artificial Sequence
  Description of Artificial Sequence: Synthetic primer
tggagaatctccagctccag

SEQ ID NO: 2085 - DNA, 20 bp, Artificial Sequence
  Description of Artificial Sequence: Synthetic primer
ggtaggaactggggaaaaac

SEQ ID NO: 2086 - DNA, 20 bp, Artificial Sequence
  Description of Artificial Sequence: Synthetic primer
tgcaaagctgtcagcaaagg

SEQ ID NO: 2087 - DNA, 20 bp, Artificial Sequence
  Description of Artificial Sequence: Synthetic primer
taagagggaacatcctggtg

SEQ ID NO: 2088 - DNA, 21 bp, Artificial Sequence
  Description of Artificial Sequence: Synthetic primer
ggtattttagagatgtagagc

SEQ ID NO: 2089 - DNA, 20 bp, Artificial Sequence
  Description of Artificial Sequence: Synthetic primer
agtggtcactaggatcacag

SEQ ID NO: 2090 - DNA, 20 bp, Artificial Sequence
  Description of Artificial Sequence: Synthetic primer
gggtaacctggtgaatcttc

SEQ ID NO: 2091 - DNA, 19 bp, Artificial Sequence
  Description of Artificial Sequence: Synthetic primer
tgtctgctgtggaaagaag

SEQ ID NO: 2092 - DNA, 20 bp, Artificial Sequence
  Description of Artificial Sequence: Synthetic primer
aagagatggtctccacttgc

SEQ ID NO: 2093 - DNA, 19 bp, Artificial Sequence
  Description of Artificial Sequence: Synthetic primer
tacaagtgattcaacacag

SEQ ID NO: 2094 - DNA, 20 bp, Artificial Sequence
  Description of Artificial Sequence: Synthetic primer
ctgcctgtatttgaccacac

SEQ ID NO: 2095 - DNA, 20 bp, Artificial Sequence
  Description of Artificial Sequence: Synthetic primer
aacactggaaagctcacacc

SEQ ID NO: 2096 - DNA, 19 bp, Artificial Sequence
  Description of Artificial Sequence: Synthetic primer
tagggcgctggagagcggg

SEQ ID NO: 2097 - DNA, 21 bp, Artificial Sequence
  Description of Artificial Sequence: Synthetic primer
gtggcattttatcttgcaaac

SEQ ID NO: 2098 - DNA, 20 bp, Artificial Sequence
  Description of Artificial Sequence: Synthetic primer
aggagccttcagattctgtg

SEQ ID NO: 2099 - DNA, 20 bp, Artificial Sequence
  Description of Artificial Sequence: Synthetic primer
ttctcctggaataagacccc

SEQ ID NO: 2100 - DNA, 20 bp, Artificial Sequence
  Description of Artificial Sequence: Synthetic primer
gctctgcactgaagctactg

SEQ ID NO: 2101 - DNA, 20 bp, Artificial Sequence
  Description of Artificial Sequence: Synthetic primer
acagtagcttcagtgcagag

SEQ ID NO: 2102 - DNA, 20 bp, Artificial Sequence
  Description of Artificial Sequence: Synthetic primer
aagtatcattccccctcacc

SEQ ID NO: 2103 - DNA, 20 bp, Artificial Sequence
  Description of Artificial Sequence: Synthetic primer
agtgggaactgagatactgg

SEQ ID NO: 2104 - DNA, 20 bp, Artificial Sequence
  Description of Artificial Sequence: Synthetic primer
tggcatgctgagaaactcac

SEQ ID NO: 2105 - DNA, 20 bp, Artificial Sequence
  Description of Artificial Sequence: Synthetic primer
ttcttcccagcatagggttg

SEQ ID NO: 2106 - DNA, 19 bp, Artificial Sequence
  Description of Artificial Sequence: Synthetic primer
gtctgaagtattgcaaagc

SEQ ID NO: 2107 - DNA, 20 bp, Artificial Sequence
  Description of Artificial Sequence: Synthetic primer
gtcttttcatactgctttgc

SEQ ID NO: 2108 - DNA, 19 bp, Artificial Sequence
  Description of Artificial Sequence: Synthetic primer
agcttgtaattcaagagtg

SEQ ID NO: 2109 - DNA, 21 bp, Artificial Sequence
  Description of Artificial Sequence: Synthetic primer
caccttaatttgcaaaagtgg

SEQ ID NO: 2110 - DNA, 19 bp, Artificial Sequence
  Description of Artificial Sequence: Synthetic primer
ttttacactcaatatgacc

SEQ ID NO: 2111 - DNA, 19 bp, Artificial Sequence
  Description of Artificial Sequence: Synthetic primer
cactttgctgttgaaattc

SEQ ID NO: 2112 - DNA, 19 bp, Artificial Sequence
  Description of Artificial Sequence: Synthetic primer
tcctggtgggacagggact

SEQ ID NO: 2113 - DNA, 19 bp, Artificial Sequence
  Description of Artificial Sequence: Synthetic primer
ttaaatgtgtggatatgtc

SEQ ID NO: 2114 - DNA, 20 bp, Artificial Sequence
  Description of Artificial Sequence: Synthetic primer
tgatgtagggcatctctagg

SEQ ID NO: 2115 - DNA, 20 bp, Artificial Sequence
  Description of Artificial Sequence: Synthetic primer
aatccagactcatgggtctc

SEQ ID NO: 2116 - DNA, 20 bp, Artificial Sequence
  Description of Artificial Sequence: Synthetic primer
cttgttaaagaagcactgtc

SEQ ID NO: 2117 - DNA, 19 bp, Artificial Sequence
  Description of Artificial Sequence: Synthetic primer
atttcaaagctagtaacag

SEQ ID NO: 2118 - DNA, 18 bp, Artificial Sequence
  Description of Artificial Sequence: Synthetic primer
tgctgcttgcagtgccta

SEQ ID NO: 2119 - DNA, 20 bp, Artificial Sequence
  Description of Artificial Sequence: Synthetic primer
ccagcaatgacatgattacc

SEQ ID NO: 2120 - DNA, 19 bp, Artificial Sequence
  Description of Artificial Sequence: Synthetic primer
cattaacataaagagaggc

SEQ ID NO: 2121 - DNA, 20 bp, Artificial Sequence
  Description of Artificial Sequence: Synthetic primer
gaattcttatatgagaggac

SEQ ID NO: 2122 - DNA, 20 bp, Artificial Sequence
  Description of Artificial Sequence: Synthetic primer
ggacaattaatctattcccc

SEQ ID NO: 2123 - DNA, 19 bp, Artificial Sequence
  Description of Artificial Sequence: Synthetic primer
tccttactgatccccagag

SEQ ID NO: 2124 - DNA, 18 bp, Artificial Sequence
  Description of Artificial Sequence: Synthetic primer
tcaagtagtgtctccctt

SEQ ID NO: 2125 - DNA, 20 bp, Artificial Sequence
  Description of Artificial Sequence: Synthetic primer
cctgaagaatcaggatcaag

SEQ ID NO: 2126 - DNA, 20 bp, Artificial Sequence
  Description of Artificial Sequence: Synthetic primer
gataggatgagcaaccaaaa

SEQ ID NO: 2127 - DNA, 20 bp, Artificial Sequence
  Description of Artificial Sequence: Synthetic primer
ggacatcatgataggatgag

SEQ ID NO: 2128 - DNA, 20 bp, Artificial Sequence
  Description of Artificial Sequence: Synthetic primer
agctatctggtagatagtgg

SEQ ID NO: 2129 - DNA, 20 bp, Artificial Sequence
  Description of Artificial Sequence: Synthetic primer
ctttctgtgtctgggccatt

SEQ ID NO: 2130 - DNA, 19 bp, Artificial Sequence
  Description of Artificial Sequence: Synthetic primer
acagacagagcacctgtgg

SEQ ID NO: 2131 - DNA, 21 bp, Artificial Sequence
  Description of Artificial Sequence: Synthetic primer
cagaaaagactcttcttgcag

SEQ ID NO: 2132 - DNA, 19 bp, Artificial Sequence
  Description of Artificial Sequence: Synthetic primer
gagtccctggtatagccac

SEQ ID NO: 2133 - DNA, 20 bp, Artificial Sequence
  Description of Artificial Sequence: Synthetic primer
ccaatgaatctcccttaaag

SEQ ID NO: 2134 - DNA, 21 bp, Artificial Sequence
  Description of Artificial Sequence: Synthetic primer
gtcaatctttattctgactac

SEQ ID NO: 2135 - DNA, 19 bp, Artificial Sequence
  Description of Artificial Sequence: Synthetic primer
tatcaccattttcctttag

SEQ ID NO: 2136 - DNA, 20 bp, Artificial Sequence
  Description of Artificial Sequence: Synthetic primer
ggagtatgaagggaatgtgg

SEQ ID NO: 2137 - DNA, 20 bp, Artificial Sequence
  Description of Artificial Sequence: Synthetic primer
ctgattggcatagtactggg

SEQ ID NO: 2138 - DNA, 21 bp, Artificial Sequence
  Description of Artificial Sequence: Synthetic primer
ggaatttgaaggagaacaagg

SEQ ID NO: 2139 - DNA, 20 bp, Artificial Sequence
  Description of Artificial Sequence: Synthetic primer
ggattgaagatttcctccac

SEQ ID NO: 2140 - DNA, 19 bp, Artificial Sequence
  Description of Artificial Sequence: Synthetic primer
tttggaaacacctccctca

SEQ ID NO: 2141 - DNA, 21 bp, Artificial Sequence
  Description of Artificial Sequence: Synthetic primer
cagtggttcattaataaactc

SEQ ID NO: 2142 - DNA, 18 bp, Artificial Sequence
  Description of Artificial Sequence: Synthetic primer
tttccagggggtccactc

SEQ ID NO: 2143 - DNA, 20 bp, Artificial Sequence
  Description of Artificial Sequence: Synthetic primer
ctcagggatgggctcttcat

SEQ ID NO: 2144 - DNA, 20 bp, Artificial Sequence
  Description of Artificial Sequence: Synthetic primer
atgccattgttgctgcttcg

SEQ ID NO: 2145 - DNA, 19 bp, Artificial Sequence
  Description of Artificial Sequence: Synthetic primer
agcaagctaccccttgcag

SEQ ID NO: 2146 - DNA, 19 bp, Artificial Sequence
  Description of Artificial Sequence: Synthetic primer
tttccttgggctgcaaggg

SEQ ID NO: 2147 - DNA, 20 bp, Artificial Sequence
  Description of Artificial Sequence: Synthetic primer
gtcacctaacgtggaatgtg

SEQ ID NO: 2148 - DNA, 20 bp, Artificial Sequence
  Description of Artificial Sequence: Synthetic primer
ttaggccctgatgatgtgtc

SEQ ID NO: 2149 - DNA, 20 bp, Artificial Sequence
  Description of Artificial Sequence: Synthetic primer
attgttgtctccctgtgagc

SEQ ID NO: 2150 - DNA, 20 bp, Artificial Sequence
  Description of Artificial Sequence: Synthetic primer
catgttctgctgctgctatg

SEQ ID NO: 2151 - DNA, 20 bp, Artificial Sequence
  Description of Artificial Sequence: Synthetic primer
ttccatagcagcagcagaac

SEQ ID NO: 2152 - DNA, 19 bp, Artificial Sequence
  Description of Artificial Sequence: Synthetic primer
aacagaagagaaggtatat

SEQ ID NO: 2153 - DNA, 20 bp, Artificial Sequence
  Description of Artificial Sequence: Synthetic primer
tgtgatccttcaggtcctgc

SEQ ID NO: 2154 - DNA, 20 bp, Artificial Sequence
  Description of Artificial Sequence: Synthetic primer
aaagggccaggagctgagac

SEQ ID NO: 2155 - DNA, 19 bp, Artificial Sequence
  Description of Artificial Sequence: Synthetic primer
gtattcaaaagccacccct

SEQ ID NO: 2156 - DNA, 20 bp, Artificial Sequence
  Description of Artificial Sequence: Synthetic primer
gttttcttgctttttgtcag

SEQ ID NO: 2157 - DNA, 20 bp, Artificial Sequence
  Description of Artificial Sequence: Synthetic primer
cgagtccttttgtcttgcac

SEQ ID NO: 2158 - DNA, 20 bp, Artificial Sequence
  Description of Artificial Sequence: Synthetic primer
ctagtctggtttaccaaaca

SEQ ID NO: 2159 - DNA, 20 bp, Artificial Sequence
  Description of Artificial Sequence: Synthetic primer
taggcttcctgcacaagtgg

SEQ ID NO: 2160 - DNA, 19 bp, Artificial Sequence
  Description of Artificial Sequence: Synthetic primer
gaatattaaggagctgtaa

SEQ ID NO: 2161 - DNA, 20 bp, Artificial Sequence
  Description of Artificial Sequence: Synthetic primer
gacaccaacaaagtctgcaa

SEQ ID NO: 2162 - DNA, 20 bp, Artificial Sequence
  Description of Artificial Sequence: Synthetic primer
aagttcaggtttggctcctc

SEQ ID NO: 2163 - DNA, 20 bp, Artificial Sequence
  Description of Artificial Sequence: Synthetic primer
ttgctccactttccactgac

SEQ ID NO: 2164 - DNA, 20 bp, Artificial Sequence
  Description of Artificial Sequence: Synthetic primer
cttgaagaaagaagttggtg

SEQ ID NO: 2165 - DNA, 19 bp, Artificial Sequence
  Description of Artificial Sequence: Synthetic primer
ctcatctctgtagatgcct

SEQ ID NO: 2166 - DNA, 20 bp, Artificial Sequence
  Description of Artificial Sequence: Synthetic primer
atcagcagccctctggaagt

SEQ ID NO: 2167 - DNA, 20 bp, Artificial Sequence
  Description of Artificial Sequence: Synthetic primer
ggagaaacgtttctctttcc

SEQ ID NO: 2168 - DNA, 19 bp, Artificial Sequence
  Description of Artificial Sequence: Synthetic primer
caacccacttcagtgccag

SEQ ID NO: 2169 - DNA, 20 bp, Artificial Sequence
  Description of Artificial Sequence: Synthetic primer
tacagtttgctctggcatgg

SEQ ID NO: 2170 - DNA, 20 bp, Artificial Sequence
  Description of Artificial Sequence: Synthetic primer
ttccagagatcagggagttg

SEQ ID NO: 2171 - DNA, 20 bp, Artificial Sequence
  Description of Artificial Sequence: Synthetic primer
tgagcaggcttgattctcac

SEQ ID NO: 2172 - DNA, 19 bp, Artificial Sequence
  Description of Artificial Sequence: Synthetic primer
gctgcctttcctgagtacc

SEQ ID NO: 2173 - DNA, 19 bp, Artificial Sequence
  Description of Artificial Sequence: Synthetic primer
tcggagggtactcaggaaa

SEQ ID NO: 2174 - DNA, 20 bp, Artificial Sequence
  Description of Artificial Sequence: Synthetic primer
acacacacttgtccatccag

SEQ ID NO: 2175 - DNA, 19 bp, Artificial Sequence
  Description of Artificial Sequence: Synthetic primer
gccaattccgtgtcagccc

SEQ ID NO: 2176 - DNA, 21 bp, Artificial Sequence
  Description of Artificial Sequence: Synthetic primer
gtcattgtagaacttttcacc

SEQ ID NO: 2177 - DNA, 21 bp, Artificial Sequence
  Description of Artificial Sequence: Synthetic primer
gttgtatggaaattatagttc

SEQ ID NO: 2178 - DNA, 21 bp, Artificial Sequence
  Description of Artificial Sequence: Synthetic primer
aataattgaactataatttcc

SEQ ID NO: 2179 - DNA, 20 bp, Artificial Sequence
  Description of Artificial Sequence: Synthetic primer
tttactaacctccctgtttg

SEQ ID NO: 2180 - DNA, 20 bp, Artificial Sequence
  Description of Artificial Sequence: Synthetic primer
gtgcaaagggcttagtgatg

SEQ ID NO: 2181 - DNA, 20 bp, Artificial Sequence
  Description of Artificial Sequence: Synthetic primer
acagtaacaccctcagatgg

SEQ ID NO: 2182 - DNA, 20 bp, Artificial Sequence
  Description of Artificial Sequence: Synthetic primer
agttctttgcctccattttc

SEQ ID NO: 2183 - DNA, 20 bp, Artificial Sequence
  Description of Artificial Sequence: Synthetic primer
taagagagctacaggtggtg

SEQ ID NO: 2184 - DNA, 20 bp, Artificial Sequence
  Description of Artificial Sequence: Synthetic primer
ccctttaaggggaaatgatt

SEQ ID NO: 2185 - DNA, 20 bp, Artificial Sequence
  Description of Artificial Sequence: Synthetic primer
ttagaaaagagactaaattc

SEQ ID NO: 2186 - DNA, 20 bp, Artificial Sequence
  Description of Artificial Sequence: Synthetic primer
ttagggtaatggtgagagag

SEQ ID NO: 2187 - DNA, 20 bp, Artificial Sequence
  Description of Artificial Sequence: Synthetic primer
ttcggatgaagatagtgggc

SEQ ID NO: 2188 - DNA, 20 bp, Artificial Sequence
  Description of Artificial Sequence: Synthetic primer
tccctctctccctgaaaaag

SEQ ID NO: 2189 - DNA, 19 bp, Artificial Sequence
  Description of Artificial Sequence: Synthetic primer
gggatgattcttaaaaggg

SEQ ID NO: 2190 - DNA, 20 bp, Artificial Sequence
  Description of Artificial Sequence: Synthetic primer
agtggggcacatgtattttg

SEQ ID NO: 2191 - DNA, 20 bp, Artificial Sequence
  Description of Artificial Sequence: Synthetic primer
agcctctattgatgcctcag

SEQ ID NO: 2192 - DNA, 20 bp, Artificial Sequence
  Description of Artificial Sequence: Synthetic primer
gtgtctagtaagacagtacc

SEQ ID NO: 2193 - DNA, 20 bp, Artificial Sequence
  Description of Artificial Sequence: Synthetic primer
ccataattgaatacctcctc

SEQ ID NO: 2194 - DNA, 20 bp, Artificial Sequence
  Description of Artificial Sequence: Synthetic primer
ctaattgctgtcgaagccac

SEQ ID NO: 2195 - DNA, 20 bp, Artificial Sequence
  Description of Artificial Sequence: Synthetic primer
gttgatggagcacctcattg

SEQ ID NO: 2196 - DNA, 20 bp, Artificial Sequence
  Description of Artificial Sequence: Synthetic primer
tgccatgctaaaactggaag

SEQ ID NO: 2197 - DNA, 21 bp, Artificial Sequence
  Description of Artificial Sequence: Synthetic primer
taaaagattaatcaatttgac

SEQ ID NO: 2198 - DNA, 20 bp, Artificial Sequence
  Description of Artificial Sequence: Synthetic primer
tgggtttacactctgatgtc

SEQ ID NO: 2199 - DNA, 20 bp, Artificial Sequence
  Description of Artificial Sequence: Synthetic primer
ggacttctccaccaaatctc

SEQ ID NO: 2200 - DNA, 19 bp, Artificial Sequence
  Description of Artificial Sequence: Synthetic primer
atcttctttaccacttttg

SEQ ID NO: 2201 - DNA, 20 bp, Artificial Sequence
  Description of Artificial Sequence: Synthetic primer
ataaaattcctatattcctg

SEQ ID NO: 2202 - DNA, 20 bp, Artificial Sequence
  Description of Artificial Sequence: Synthetic primer
ttttctcactatttttcaag

SEQ ID NO: 2203 - DNA, 20 bp, Artificial Sequence
  Description of Artificial Sequence: Synthetic primer
gctttaatggtccataggtc

SEQ ID NO: 2204 - DNA, 19 bp, Artificial Sequence
  Description of Artificial Sequence: Synthetic primer
agcagttgaaaacaaattc

SEQ ID NO: 2205 - DNA, 21 bp, Artificial Sequence
  Description of Artificial Sequence: Synthetic primer
gtaaacaattgtctaaactgg

SEQ ID NO: 2206 - DNA, 20 bp, Artificial Sequence
  Description of Artificial Sequence: Synthetic primer
taagtcatacagacattccc

SEQ ID NO: 2207 - DNA, 20 bp, Artificial Sequence
  Description of Artificial Sequence: Synthetic primer
ggaagaataaacaaacattg

SEQ ID NO: 2208 - DNA, 20 bp, Artificial Sequence
  Description of Artificial Sequence: Synthetic primer
cataccgaaagaaaaccccc

SEQ ID NO: 2209 - DNA, 20 bp, Artificial Sequence
  Description of Artificial Sequence: Synthetic primer
gatataaattattccagtgt

SEQ ID NO: 2210 - DNA, 20 bp, Artificial Sequence
  Description of Artificial Sequence: Synthetic primer
tgtttcccatatccttgcag

SEQ ID NO: 2211 - DNA, 19 bp, Artificial Sequence
  Description of Artificial Sequence: Synthetic primer
tatggtaagtgtctaatag

SEQ ID NO: 2212 - DNA, 19 bp, Artificial Sequence
  Description of Artificial Sequence: Synthetic primer
agtcaccatggtttactcc

SEQ ID NO: 2213 - DNA, 20 bp, Artificial Sequence
  Description of Artificial Sequence: Synthetic primer
cccacaatctaatcttctgg

SEQ ID NO: 2214 - DNA, 21 bp, Artificial Sequence
  Description of Artificial Sequence: Synthetic primer
ctgcagtatgtgaatataagc

SEQ ID NO: 2215 - DNA, 20 bp, Artificial Sequence
  Description of Artificial Sequence: Synthetic primer
gactaggttactgagcaagg

SEQ ID NO: 2216 - DNA, 20 bp, Artificial Sequence
  Description of Artificial Sequence: Synthetic primer
ctcttaaggaacattctctg

SEQ ID NO: 2217 - DNA, 20 bp, Artificial Sequence
  Description of Artificial Sequence: Synthetic primer
actctgtcatctggtttccc

SEQ ID NO: 2218 - DNA, 19 bp, Artificial Sequence
  Description of Artificial Sequence: Synthetic primer
tataaaatatccccattgc

SEQ ID NO: 2219 - DNA, 20 bp, Artificial Sequence
  Description of Artificial Sequence: Synthetic primer
cggaagaaacaaacaagagc

SEQ ID NO: 2220 - DNA, 20 bp, Artificial Sequence
  Description of Artificial Sequence: Synthetic primer
agctccgctttgatttcagg

SEQ ID NO: 2221 - DNA, 19 bp, Artificial Sequence
  Description of Artificial Sequence: Synthetic primer
gaagtaagacatacactta

SEQ ID NO: 2222 - DNA, 20 bp, Artificial Sequence
  Description of Artificial Sequence: Synthetic primer
ctttcatgggagaaatgtgg

SEQ ID NO: 2223 - DNA, 20 bp, Artificial Sequence
  Description of Artificial Sequence: Synthetic primer
agcactgcaggtccaaaatg

SEQ ID NO: 2224 - DNA, 19 bp, Artificial Sequence
  Description of Artificial Sequence: Synthetic primer
atgcattcatcaagcaact

SEQ ID NO: 2225 - DNA, 20 bp, Artificial Sequence
  Description of Artificial Sequence: Synthetic primer
agtgaactatgataggaagc

SEQ ID NO: 2226 - DNA, 20 bp, Artificial Sequence
  Description of Artificial Sequence: Synthetic primer
gagctggatccatccatcac

SEQ ID NO: 2227 - DNA, 19 bp, Artificial Sequence
  Description of Artificial Sequence: Synthetic primer
gtctgaaaaactgtcattc

SEQ ID NO: 2228 - DNA, 20 bp, Artificial Sequence
  Description of Artificial Sequence: Synthetic primer
ttgtgacatgataaagctgg

SEQ ID NO: 2229 - DNA, 19 bp, Artificial Sequence
  Description of Artificial Sequence: Synthetic primer
tataccttagaatagtcag

SEQ ID NO: 2230 - DNA, 20 bp, Artificial Sequence
  Description of Artificial Sequence: Synthetic primer
tgcaattcacttggacacgg

SEQ ID NO: 2231 - DNA, 20 bp, Artificial Sequence
  Description of Artificial Sequence: Synthetic primer
atatacacacccttccctgc

SEQ ID NO: 2232 - DNA, 20 bp, Artificial Sequence
  Description of Artificial Sequence: Synthetic primer
agtcaaatgtgcagggaagg

SEQ ID NO: 2233 - DNA, 20 bp, Artificial Sequence
  Description of Artificial Sequence: Synthetic primer
tggtagagactcacgcaaag

SEQ ID NO: 2234 - DNA, 20 bp, Artificial Sequence
  Description of Artificial Sequence: Synthetic primer
attagggtgcagacaaggag

SEQ ID NO: 2235 - DNA, 20 bp, Artificial Sequence
  Description of Artificial Sequence: Synthetic primer
attcagcctggtgaatgaag

SEQ ID NO: 2236 - DNA, 20 bp, Artificial Sequence
  Description of Artificial Sequence: Synthetic primer
tagtgaagctgtcggtagtg

SEQ ID NO: 2237 - DNA, 20 bp, Artificial Sequence
  Description of Artificial Sequence: Synthetic primer
tgactttggaggtgggatac

SEQ ID NO: 2238 - DNA, 20 bp, Artificial Sequence
  Description of Artificial Sequence: Synthetic primer
tgctcctcctaaaccttctc

SEQ ID NO: 2239 - DNA, 20 bp, Artificial Sequence
  Description of Artificial Sequence: Synthetic primer
gcaagatgagaaggtttagg

SEQ ID NO: 2240 - DNA, 20 bp, Artificial Sequence
  Description of Artificial Sequence: Synthetic primer
ttcatagaaccatgccaccc

SEQ ID NO: 2241 - DNA, 21 bp, Artificial Sequence
  Description of Artificial Sequence: Synthetic primer
gaagcaatttcaagctaacag

SEQ ID NO: 2242 - DNA, 20 bp, Artificial Sequence
  Description of Artificial Sequence: Synthetic primer
caagcttttctcttgtagtc

SEQ ID NO: 2243 - DNA, 19 bp, Artificial Sequence
  Description of Artificial Sequence: Synthetic primer
ttagattgttatccccact

SEQ ID NO: 2244 - DNA, 20 bp, Artificial Sequence
  Description of Artificial Sequence: Synthetic primer
gttcttcgtaaatcaaaccc

SEQ ID NO: 2245 - DNA, 19 bp, Artificial Sequence
  Description of Artificial Sequence: Synthetic primer
gaaacacttcagtttcttg

SEQ ID NO: 2246 - DNA, 20 bp, Artificial Sequence
  Description of Artificial Sequence: Synthetic primer
gtgtttcttttttcacctgc

SEQ ID NO: 2247 - DNA, 20 bp, Artificial Sequence
  Description of Artificial Sequence: Synthetic primer
aatgattctgactggtttcc

SEQ ID NO: 2248 - DNA, 20 bp, Artificial Sequence
  Description of Artificial Sequence: Synthetic primer
aaccagtacagattagttgc

SEQ ID NO: 2249 - DNA, 20 bp, Artificial Sequence
  Description of Artificial Sequence: Synthetic primer
gcatgcttctagtggtttac

SEQ ID NO: 2250 - DNA, 20 bp, Artificial Sequence
  Description of Artificial Sequence: Synthetic primer
ttcctgatgataatcttccc

SEQ ID NO: 2251 - DNA, 19 bp, Artificial Sequence
  Description of Artificial Sequence: Synthetic primer
tctatgcctaaaataagtg

SEQ ID NO: 2252 - DNA, 19 bp, Artificial Sequence
  Description of Artificial Sequence: Synthetic primer
ttctgcaaattaccatttc

SEQ ID NO: 2253 - DNA, 19 bp, Artificial Sequence
  Description of Artificial Sequence: Synthetic primer
gggaactgttaagaaactc

SEQ ID NO: 2254 - DNA, 20 bp, Artificial Sequence
  Description of Artificial Sequence: Synthetic primer
gtcacacagagttctgtgag

SEQ ID NO: 2255 - DNA, 19 bp, Artificial Sequence
  Description of Artificial Sequence: Synthetic primer
aacggccagggtggacact

SEQ ID NO: 2256 - DNA, 20 bp, Artificial Sequence
  Description of Artificial Sequence: Synthetic primer
gcatcaggacaaactgatgg

SEQ ID NO: 2257 - DNA, 20 bp, Artificial Sequence
  Description of Artificial Sequence: Synthetic primer
acccagtcttcctgagtatg

SEQ ID NO: 2258 - DNA, 21 bp, Artificial Sequence
  Description of Artificial Sequence: Synthetic primer
gtgctataaagctttaacaag

SEQ ID NO: 2259 - DNA, 20 bp, Artificial Sequence
  Description of Artificial Sequence: Synthetic primer
aagaactccagggctacttg

SEQ ID NO: 2260 - DNA, 20 bp, Artificial Sequence
  Description of Artificial Sequence: Synthetic primer
gatgcttctaaggaccatgt

SEQ ID NO: 2261 - DNA, 20 bp, Artificial Sequence
  Description of Artificial Sequence: Synthetic primer
tgcacagttgaaaagtaacc

SEQ ID NO: 2262 - DNA, 20 bp, Artificial Sequence
  Description of Artificial Sequence: Synthetic primer
caaattctatggcatctttc

SEQ ID NO: 2263 - DNA, 20 bp, Artificial Sequence
  Description of Artificial Sequence: Synthetic primer
gcctaacatattgtatgcac

SEQ ID NO: 2264 - DNA, 20 bp, Artificial Sequence
  Description of Artificial Sequence: Synthetic primer
gccatttgaagaatggtatg

SEQ ID NO: 2265 - DNA, 20 bp, Artificial Sequence
  Description of Artificial Sequence: Synthetic primer
gtaccttattttcctcacac

SEQ ID NO: 2266 - DNA, 20 bp, Artificial Sequence
  Description of Artificial Sequence: Synthetic primer
gagagtgagtgagacttcag

SEQ ID NO: 2267 - DNA, 20 bp, Artificial Sequence
  Description of Artificial Sequence: Synthetic primer
tgattgggctgaagtctcac

SEQ ID NO: 2268 - DNA, 20 bp, Artificial Sequence
  Description of Artificial Sequence: Synthetic primer
attcagcaggcaatggagag

SEQ ID NO: 2269 - DNA, 19 bp, Artificial Sequence
  Description of Artificial Sequence: Synthetic primer
gcctttatcttcacagccc

SEQ ID NO: 2270 - DNA, 21 bp, Artificial Sequence
  Description of Artificial Sequence: Synthetic primer
ggttagtctaagataaaactc

SEQ ID NO: 2271 - DNA, 20 bp, Artificial Sequence
  Description of Artificial Sequence: Synthetic primer
acaaccaagtcctactgaac

SEQ ID NO: 2272 - DNA, 20 bp, Artificial Sequence
  Description of Artificial Sequence: Synthetic primer
gtctaccctgtccattgaag

SEQ ID NO: 2273 - DNA, 20 bp, Artificial Sequence
  Description of Artificial Sequence: Synthetic primer
gtcacccagtatatttctcc

SEQ ID NO: 2274 - DNA, 20 bp, Artificial Sequence
  Description of Artificial Sequence: Synthetic primer
ctgtgttgatgtggtagccc

SEQ ID NO: 2275 - DNA, 21 bp, Artificial Sequence
  Description of Artificial Sequence: Synthetic primer
caatgcaaacacttttaagac

SEQ ID NO: 2276 - DNA, 19 bp, Artificial Sequence
  Description of Artificial Sequence: Synthetic primer
gtcaataacaacaatgtcc

SEQ ID NO: 2277 - DNA, 20 bp, Artificial Sequence
  Description of Artificial Sequence: Synthetic primer
tatagattattgaatctgac

SEQ ID NO: 2278 - DNA, 20 bp, Artificial Sequence
  Description of Artificial Sequence: Synthetic primer
actgcatttgaagtagatgg

SEQ ID NO: 2279 - DNA, 20 bp, Artificial Sequence
  Description of Artificial Sequence: Synthetic primer
tgtgcctttgccgaaaccag

SEQ ID NO: 2280 - DNA, 20 bp, Artificial Sequence
  Description of Artificial Sequence: Synthetic primer
tacctctgatgagcatcagc

SEQ ID NO: 2281 - DNA, 20 bp, Artificial Sequence
  Description of Artificial Sequence: Synthetic primer
tcatttaattaatcatcagg

SEQ ID NO: 2282 - DNA, 20 bp, Artificial Sequence
  Description of Artificial Sequence: Synthetic primer
cagagtaggtgtccttacag

SEQ ID NO: 2283 - DNA, 20 bp, Artificial Sequence
  Description of Artificial Sequence: Synthetic primer
caggtgtttttggtaaccag

SEQ ID NO: 2284 - DNA, 21 bp, Artificial Sequence
  Description of Artificial Sequence: Synthetic primer
ccaggtactgttgtttttgac

SEQ ID NO: 2285 - DNA, 20 bp, Artificial Sequence
  Description of Artificial Sequence: Synthetic primer
tactacgtttttatacttac

SEQ ID NO: 2286 - DNA, 19 bp, Artificial Sequence
  Description of Artificial Sequence: Synthetic primer
tagtcgaccctgggcaatt

SEQ ID NO: 2287 - DNA, 21 bp, Artificial Sequence
  Description of Artificial Sequence: Synthetic primer
gtaagatgaatacacaaaggc

SEQ ID NO: 2288 - DNA, 19 bp, Artificial Sequence
  Description of Artificial Sequence: Synthetic primer
ggttacatatcactgcaag

SEQ ID NO: 2289 - DNA, 20 bp, Artificial Sequence
  Description of Artificial Sequence: Synthetic primer
atgatactccccaaagtctc

SEQ ID NO: 2290 - DNA, 20 bp, Artificial Sequence
  Description of Artificial Sequence: Synthetic primer
ctccccaaagtctcagatag

SEQ ID NO: 2291 - DNA, 20 bp, Artificial Sequence
  Description of Artificial Sequence: Synthetic primer
agagaatttggggcctggct

SEQ ID NO: 2292 - DNA, 20 bp, Artificial Sequence
  Description of Artificial Sequence: Synthetic primer
tgagataagtggctacgttg

SEQ ID NO: 2293 - DNA, 20 bp, Artificial Sequence
  Description of Artificial Sequence: Synthetic primer
tggttctcaacactgaccac

SEQ ID NO: 2294 - DNA, 20 bp, Artificial Sequence
  Description of Artificial Sequence: Synthetic primer
ggacatatggccttgcttag

SEQ ID NO: 2295 - DNA, 20 bp, Artificial Sequence
  Description of Artificial Sequence: Synthetic primer
gctctacactctagaagaag

SEQ ID NO: 2296 - DNA, 19 bp, Artificial Sequence
  Description of Artificial Sequence: Synthetic primer
atctacaaaggataatcag

SEQ ID NO: 2297 - DNA, 20 bp, Artificial Sequence
  Description of Artificial Sequence: Synthetic primer
actctgtctcctataatctg

SEQ ID NO: 2298 - DNA, 19 bp, Artificial Sequence
  Description of Artificial Sequence: Synthetic primer
tcctttgtagataatttcc

SEQ ID NO: 2299 - DNA, 20 bp, Artificial Sequence
  Description of Artificial Sequence: Synthetic primer
cctgaagtatgttagtagac

SEQ ID NO: 2300 - DNA, 19 bp, Artificial Sequence
  Description of Artificial Sequence: Synthetic primer
taagtcatttacttctcag

SEQ ID NO: 2301 - DNA, 20 bp, Artificial Sequence
  Description of Artificial Sequence: Synthetic primer
tggtggacgaatgtcaaaaa

SEQ ID NO: 2302 - DNA, 20 bp, Artificial Sequence
  Description of Artificial Sequence: Synthetic primer
cagattgaccacctccaaag

SEQ ID NO: 2303 - DNA, 20 bp, Artificial Sequence
  Description of Artificial Sequence: Synthetic primer
cccattcttcttaatgtcag

SEQ ID NO: 2304 - DNA, 20 bp, Artificial Sequence
  Description of Artificial Sequence: Synthetic primer
atatatctgggcctggctac

SEQ ID NO: 2305 - DNA, 20 bp, Artificial Sequence
  Description of Artificial Sequence: Synthetic primer
gcatacagagaggagctagt

SEQ ID NO: 2306 - DNA, 20 bp, Artificial Sequence
  Description of Artificial Sequence: Synthetic primer
ctctccatgatgtactgtag

SEQ ID NO: 2307 - DNA, 20 bp, Artificial Sequence
  Description of Artificial Sequence: Synthetic primer
atttgcccaatgcaagccag

SEQ ID NO: 2308 - DNA, 20 bp, Artificial Sequence
  Description of Artificial Sequence: Synthetic primer
atttgcccaatgcaagccag

SEQ ID NO: 2309 - DNA, 20 bp, Artificial Sequence
  Description of Artificial Sequence: Synthetic primer
atctaacgaggatctgcacc

SEQ ID NO: 2310 - DNA, 20 bp, Artificial Sequence
  Description of Artificial Sequence: Synthetic primer
tcaattcctctctaagagcc

SEQ ID NO: 2311 - DNA, 19 bp, Artificial Sequence
  Description of Artificial Sequence: Synthetic primer
cgccgcacatcccctctcg

SEQ ID NO: 2312 - DNA, 20 bp, Artificial Sequence
  Description of Artificial Sequence: Synthetic primer
tgagagtcatcaaaaaggtc

SEQ ID NO: 2313 - DNA, 18 bp, Artificial Sequence
  Description of Artificial Sequence: Synthetic primer
aacctgttcagtgctgcc

SEQ ID NO: 2314 - DNA, 20 bp, Artificial Sequence
  Description of Artificial Sequence: Synthetic primer
aaaggaacgaaagcaacggg

SEQ ID NO: 2315 - DNA, 20 bp, Artificial Sequence
  Description of Artificial Sequence: Synthetic primer
aaaggaacgaaagcaacggg

SEQ ID NO: 2316 - DNA, 20 bp, Artificial Sequence
  Description of Artificial Sequence: Synthetic primer
actgatttcccagcacccac

SEQ ID NO: 2317 - DNA, 20 bp, Artificial Sequence
  Description of Artificial Sequence: Synthetic primer
catttatagtctatacgtgc

SEQ ID NO: 2318 - DNA, 20 bp, Artificial Sequence
  Description of Artificial Sequence: Synthetic primer
gacttgaatttaactgctcc

SEQ ID NO: 2319 - DNA, 18 bp, Artificial Sequence
  Description of Artificial Sequence: Synthetic primer
ctggggcaaggttgggat

SEQ ID NO: 2320 - DNA, 19 bp, Artificial Sequence
  Description of Artificial Sequence: Synthetic primer
tggggctgcagctgcgaga

SEQ ID NO: 2321 - DNA, 20 bp, Artificial Sequence
  Description of Artificial Sequence: Synthetic primer
cccttttctactcacattcc

SEQ ID NO: 2322 - DNA, 20 bp, Artificial Sequence
  Description of Artificial Sequence: Synthetic primer
gataacataagattaggaac

SEQ ID NO: 2323 - DNA, 20 bp, Artificial Sequence
  Description of Artificial Sequence: Synthetic primer
ccaataggcattgctaaact

SEQ ID NO: 2324 - DNA, 21 bp, Artificial Sequence
  Description of Artificial Sequence: Synthetic primer
gttctgaatttagatgtacgg

SEQ ID NO: 2325 - DNA, 20 bp, Artificial Sequence
  Description of Artificial Sequence: Synthetic primer
actcttagccctttcacagc

SEQ ID NO: 2326 - DNA, 20 bp, Artificial Sequence
  Description of Artificial Sequence: Synthetic primer
agtgtgctatactggactac

SEQ ID NO: 2327 - DNA, 20 bp, Artificial Sequence
  Description of Artificial Sequence: Synthetic primer
cgtcaagtgagtatactgtg

SEQ ID NO: 2328 - DNA, 22 bp, Artificial Sequence
  Description of Artificial Sequence: Synthetic primer
aaaatatatattgaaagaaaac

SEQ ID NO: 2329 - DNA, 20 bp, Artificial Sequence
  Description of Artificial Sequence: Synthetic primer
tgggaggaatgtgagttggg

SEQ ID NO: 2330 - DNA, 20 bp, Artificial Sequence
  Description of Artificial Sequence: Synthetic primer
ccacacacagtaagagccac

SEQ ID NO: 2331 - DNA, 19 bp, Artificial Sequence
  Description of Artificial Sequence: Synthetic primer
tgcacgcagcatcaccagt

SEQ ID NO: 2332 - DNA, 20 bp, Artificial Sequence
  Description of Artificial Sequence: Synthetic primer
aagatcaggaatggacaggg

SEQ ID NO: 2333 - DNA, 20 bp, Artificial Sequence
  Description of Artificial Sequence: Synthetic primer
atatgaggagggactcactg

SEQ ID NO: 2334 - DNA, 19 bp, Artificial Sequence
  Description of Artificial Sequence: Synthetic primer
atgggtctggcaaggttgg

SEQ ID NO: 2335 - DNA, 20 bp, Artificial Sequence
  Description of Artificial Sequence: Synthetic primer
agttctgttgggcagacttc

SEQ ID NO: 2336 - DNA, 20 bp, Artificial Sequence
  Description of Artificial Sequence: Synthetic primer
acatgtggtgtgcctgtgtc

SEQ ID NO: 2337 - DNA, 20 bp, Artificial Sequence
  Description of Artificial Sequence: Synthetic primer
atggcccctcctccctatac

SEQ ID NO: 2338 - DNA, 20 bp, Artificial Sequence
  Description of Artificial Sequence: Synthetic primer
tcctagcagccatggcaatc

SEQ ID NO: 2339 - DNA, 20 bp, Artificial Sequence
  Description of Artificial Sequence: Synthetic primer
ggaacactgtggacttgttg

SEQ ID NO: 2340 - DNA, 19 bp, Artificial Sequence
  Description of Artificial Sequence: Synthetic primer
aggccaagagaggcacaag

SEQ ID NO: 2341 - DNA, 19 bp, Artificial Sequence
  Description of Artificial Sequence: Synthetic primer
agaggtcctcagagaccag

SEQ ID NO: 2342 - DNA, 19 bp, Artificial Sequence
  Description of Artificial Sequence: Synthetic primer
ctgctggatctggtagtca

SEQ ID NO: 2343 - DNA, 20 bp, Artificial Sequence
  Description of Artificial Sequence: Synthetic primer
tgctcatctgaggcctcagt

SEQ ID NO: 2344 - DNA, 20 bp, Artificial Sequence
  Description of Artificial Sequence: Synthetic primer
taacaggtgtttccagttgc

SEQ ID NO: 2345 - DNA, 19 bp, Artificial Sequence
  Description of Artificial Sequence: Synthetic primer
tgcctgcatgaccccgcac

SEQ ID NO: 2346 - DNA, 19 bp, Artificial Sequence
  Description of Artificial Sequence: Synthetic primer
tccacagaggggcctctcc

SEQ ID NO: 2347 - DNA, 20 bp, Artificial Sequence
  Description of Artificial Sequence: Synthetic primer
gcttagttcaggatgtgggc

SEQ ID NO: 2348 - DNA, 19 bp, Artificial Sequence
  Description of Artificial Sequence: Synthetic primer
tgaggcctgctgcagcgac

SEQ ID NO: 2349 - DNA, 20 bp, Artificial Sequence
  Description of Artificial Sequence: Synthetic primer
agaatgccctgagtgaggag

SEQ ID NO: 2350 - DNA, 18 bp, Artificial Sequence
  Description of Artificial Sequence: Synthetic primer
gctggggtgggcatcagg

SEQ ID NO: 2351 - DNA, 18 bp, Artificial Sequence
  Description of Artificial Sequence: Synthetic primer
cacaggcctgatgcccac

SEQ ID NO: 2352 - DNA, 19 bp, Artificial Sequence
  Description of Artificial Sequence: Synthetic primer
cctagatgtcagccgtgag

SEQ ID NO: 2353 - DNA, 19 bp, Artificial Sequence
  Description of Artificial Sequence: Synthetic primer
cctccaccctcacggctga

SEQ ID NO: 2354 - DNA, 19 bp, Artificial Sequence
  Description of Artificial Sequence: Synthetic primer
gggtaaggagaggggtctt

SEQ ID NO: 2355 - DNA, 20 bp, Artificial Sequence
  Description of Artificial Sequence: Synthetic primer
aggaccgcatccaacagaga

SEQ ID NO: 2356 - DNA, 20 bp, Artificial Sequence
  Description of Artificial Sequence: Synthetic primer
atgccactgccctgtcctat

SEQ ID NO: 2357 - DNA, 19 bp, Artificial Sequence
  Description of Artificial Sequence: Synthetic primer
gaggacagggtcagtcccg

SEQ ID NO: 2358 - DNA, 19 bp, Artificial Sequence
  Description of Artificial Sequence: Synthetic primer
tcccactgaccccaaggag

SEQ ID NO: 2359 - DNA, 20 bp, Artificial Sequence
  Description of Artificial Sequence: Synthetic primer
cagagcaagccccttagatg

SEQ ID NO: 2360 - DNA, 20 bp, Artificial Sequence
  Description of Artificial Sequence: Synthetic primer
tccaggctgcgttcagattc

SEQ ID NO: 2361 - DNA, 18 bp, Artificial Sequence
  Description of Artificial Sequence: Synthetic primer
ttgggatcatggcacagg

SEQ ID NO: 2362 - DNA, 20 bp, Artificial Sequence
  Description of Artificial Sequence: Synthetic primer
gcagtttaaaccaccatttc

SEQ ID NO: 2363 - DNA, 19 bp, Artificial Sequence
  Description of Artificial Sequence: Synthetic primer
gtgcagcacagaacaacgc

SEQ ID NO: 2364 - DNA, 20 bp, Artificial Sequence
  Description of Artificial Sequence: Synthetic primer
agtcctaactgaaagacaga

SEQ ID NO: 2365 - DNA, 19 bp, Artificial Sequence
  Description of Artificial Sequence: Synthetic primer
ttagcaactgactgtcata

SEQ ID NO: 2366 - DNA, 20 bp, Artificial Sequence
  Description of Artificial Sequence: Synthetic primer
aatctgggtttccttgaggg

SEQ ID NO: 2367 - DNA, 20 bp, Artificial Sequence
  Description of Artificial Sequence: Synthetic primer
ataaggtgaggcttgcgctg

SEQ ID NO: 2368 - DNA, 20 bp, Artificial Sequence
  Description of Artificial Sequence: Synthetic primer
cttccctgatgatgaatggc

SEQ ID NO: 2369 - DNA, 20 bp, Artificial Sequence
  Description of Artificial Sequence: Synthetic primer
cctcagaaatagcatgcagg

SEQ ID NO: 2370 - DNA, 20 bp, Artificial Sequence
  Description of Artificial Sequence: Synthetic primer
acctgaatgtgcatgggaag

SEQ ID NO: 2371 - DNA, 20 bp, Artificial Sequence
  Description of Artificial Sequence: Synthetic primer
caaggcttgggtaagaaggg

SEQ ID NO: 2372 - DNA, 20 bp, Artificial Sequence
  Description of Artificial Sequence: Synthetic primer
aagaagaccccttcttaccc

SEQ ID NO: 2373 - DNA, 20 bp, Artificial Sequence
  Description of Artificial Sequence: Synthetic primer
ctgctctatcttgtcaggtg

SEQ ID NO: 2374 - DNA, 20 bp, Artificial Sequence
  Description of Artificial Sequence: Synthetic primer
tagtggaaaagggagttcgg

SEQ ID NO: 2375 - DNA, 20 bp, Artificial Sequence
  Description of Artificial Sequence: Synthetic primer
cgtcaaaagtgagtgggaag

SEQ ID NO: 2376 - DNA, 20 bp, Artificial Sequence
  Description of Artificial Sequence: Synthetic primer
tatgaaggttgcaaagaggg

SEQ ID NO: 2377 - DNA, 20 bp, Artificial Sequence
  Description of Artificial Sequence: Synthetic primer
cacccctctttgcaaccttc

SEQ ID NO: 2378 - DNA, 20 bp, Artificial Sequence
  Description of Artificial Sequence: Synthetic primer
ttggatggaggcacagtgag

SEQ ID NO: 2379 - DNA, 20 bp, Artificial Sequence
  Description of Artificial Sequence: Synthetic primer
attgagttagcactggctcc

SEQ ID NO: 2380 - DNA, 20 bp, Artificial Sequence
  Description of Artificial Sequence: Synthetic primer
ggaactaaggcaaagatgag

SEQ ID NO: 2381 - DNA, 20 bp, Artificial Sequence
  Description of Artificial Sequence: Synthetic primer
caggcaagaggtctttccag

SEQ ID NO: 2382 - DNA, 20 bp, Artificial Sequence
  Description of Artificial Sequence: Synthetic primer
gttgcctcatctttcccttc

SEQ ID NO: 2383 - DNA, 20 bp, Artificial Sequence
  Description of Artificial Sequence: Synthetic primer
cagggtgaggaatacattgg

SEQ ID NO: 2384 - DNA, 20 bp, Artificial Sequence
  Description of Artificial Sequence: Synthetic primer
tcagcagctctgtctttatg

SEQ ID NO: 2385 - DNA, 20 bp, Artificial Sequence
  Description of Artificial Sequence: Synthetic primer
ccttcataacgttatacacc

SEQ ID NO: 2386 - DNA, 20 bp, Artificial Sequence
  Description of Artificial Sequence: Synthetic primer
agggctttctgtctgtgctg

SEQ ID NO: 2387 - DNA, 20 bp, Artificial Sequence
  Description of Artificial Sequence: Synthetic primer
tgcgtgtcagaagatgctac

SEQ ID NO: 2388 - DNA, 20 bp, Artificial Sequence
  Description of Artificial Sequence: Synthetic primer
tgaaagtgactggagccaag

SEQ ID NO: 2389 - DNA, 20 bp, Artificial Sequence
  Description of Artificial Sequence: Synthetic primer
cgagaaatggtgagtgtggg

SEQ ID NO: 2390 - DNA, 19 bp, Artificial Sequence
  Description of Artificial Sequence: Synthetic primer
tgcagggacaggacaggac

SEQ ID NO: 2391 - DNA, 19 bp, Artificial Sequence
  Description of Artificial Sequence: Synthetic primer
ctgaaatgtgcaataaagg

SEQ ID NO: 2392 - DNA, 21 bp, Artificial Sequence
  Description of Artificial Sequence: Synthetic primer
gtcctttattgcacatttcag

SEQ ID NO: 2393 - DNA, 20 bp, Artificial Sequence
  Description of Artificial Sequence: Synthetic primer
agtgccaggggattattttc

SEQ ID NO: 2394 - DNA, 20 bp, Artificial Sequence
  Description of Artificial Sequence: Synthetic primer
taagggcgtttgtgctaagg

SEQ ID NO: 2395 - DNA, 20 bp, Artificial Sequence
  Description of Artificial Sequence: Synthetic primer
ccgaatgtggctaaggaaac

SEQ ID NO: 2396 - DNA, 20 bp, Artificial Sequence
  Description of Artificial Sequence: Synthetic primer
ctggaagattaccaaagggc

SEQ ID NO: 2397 - DNA, 20 bp, Artificial Sequence
  Description of Artificial Sequence: Synthetic primer
gcccaagatacaaaccagag

SEQ ID NO: 2398 - DNA, 20 bp, Artificial Sequence
  Description of Artificial Sequence: Synthetic primer
cagccctttggtaatcttcc

SEQ ID NO: 2399 - DNA, 20 bp, Artificial Sequence
  Description of Artificial Sequence: Synthetic primer
gatatttctctcacccccag

SEQ ID NO: 2400 - DNA, 20 bp, Artificial Sequence
  Description of Artificial Sequence: Synthetic primer
tcactgaagtgctcaatgcc

SEQ ID NO: 2401 - DNA, 20 bp, Artificial Sequence
  Description of Artificial Sequence: Synthetic primer
tgtgtgcagaacaaagcctc

SEQ ID NO: 2402 - DNA, 20 bp, Artificial Sequence
  Description of Artificial Sequence: Synthetic primer
cctacatgcttctaacccac

SEQ ID NO: 2403 - DNA, 20 bp, Artificial Sequence
  Description of Artificial Sequence: Synthetic primer
aagctgttgtgagcacaatt

SEQ ID NO: 2404 - DNA, 20 bp, Artificial Sequence
  Description of Artificial Sequence: Synthetic primer
tgtgctcacaacagctttcc

SEQ ID NO: 2405 - DNA, 20 bp, Artificial Sequence
  Description of Artificial Sequence: Synthetic primer
taagccaggagtcttctagg

SEQ ID NO: 2406 - DNA, 20 bp, Artificial Sequence
  Description of Artificial Sequence: Synthetic primer
catacacaggtgcctagaag

SEQ ID NO: 2407 - DNA, 20 bp, Artificial Sequence
  Description of Artificial Sequence: Synthetic primer
acccaggtttcttggactac

SEQ ID NO: 2408 - DNA, 20 bp, Artificial Sequence
  Description of Artificial Sequence: Synthetic primer
agctaagtctgaggtaaggg

SEQ ID NO: 2409 - DNA, 20 bp, Artificial Sequence
  Description of Artificial Sequence: Synthetic primer
cagatcccgaatctagctgt

SEQ ID NO: 2410 - DNA, 20 bp, Artificial Sequence
  Description of Artificial Sequence: Synthetic primer
gatctggagactcaaactgg

SEQ ID NO: 2411 - DNA, 20 bp, Artificial Sequence
  Description of Artificial Sequence: Synthetic primer
aatatttattcttagcaagg

SEQ ID NO: 2412 - DNA, 19 bp, Artificial Sequence
  Description of Artificial Sequence: Synthetic primer
ggacagaagagaagttatt

SEQ ID NO: 2413 - DNA, 20 bp, Artificial Sequence
  Description of Artificial Sequence: Synthetic primer
cagatttctcttggtcaggc

SEQ ID NO: 2414 - DNA, 20 bp, Artificial Sequence
  Description of Artificial Sequence: Synthetic primer
catggagatctgtcccaacc

SEQ ID NO: 2415 - DNA, 19 bp, Artificial Sequence
  Description of Artificial Sequence: Synthetic primer
ttcttcacaagtctcaaag

SEQ ID NO: 2416 - DNA, 19 bp, Artificial Sequence
  Description of Artificial Sequence: Synthetic primer
ggactaagcgtaaatttgc

SEQ ID NO: 2417 - DNA, 20 bp, Artificial Sequence
  Description of Artificial Sequence: Synthetic primer
gcagataagtcaaaacaagg

SEQ ID NO: 2418 - DNA, 20 bp, Artificial Sequence
  Description of Artificial Sequence: Synthetic primer
gtttcaaaaccaacatggta

SEQ ID NO: 2419 - DNA, 19 bp, Artificial Sequence
  Description of Artificial Sequence: Synthetic primer
gaggtccttgccttatcac

SEQ ID NO: 2420 - DNA, 19 bp, Artificial Sequence
  Description of Artificial Sequence: Synthetic primer
aagtttcctgtagaaagag

SEQ ID NO: 2421 - DNA, 20 bp, Artificial Sequence
  Description of Artificial Sequence: Synthetic primer
ttctacattcctggcctgag

SEQ ID NO: 2422 - DNA, 20 bp, Artificial Sequence
  Description of Artificial Sequence: Synthetic primer
ttagatatggctgagaagtg

SEQ ID NO: 2423 - DNA, 20 bp, Artificial Sequence
  Description of Artificial Sequence: Synthetic primer
aatgtcaggttgttgactgc

SEQ ID NO: 2424 - DNA, 19 bp, Artificial Sequence
  Description of Artificial Sequence: Synthetic primer
catacaagtaaagaaccca

SEQ ID NO: 2425 - DNA, 20 bp, Artificial Sequence
  Description of Artificial Sequence: Synthetic primer
tgaagttataaatcagtaag

SEQ ID NO: 2426 - DNA, 20 bp, Artificial Sequence
  Description of Artificial Sequence: Synthetic primer
atggagagatggcaagtgag

SEQ ID NO: 2427 - DNA, 20 bp, Artificial Sequence
  Description of Artificial Sequence: Synthetic primer
gctgacagcatcagctttag

SEQ ID NO: 2428 - DNA, 20 bp, Artificial Sequence
  Description of Artificial Sequence: Synthetic primer
ctcaaaatgtgtctacaagc

SEQ ID NO: 2429 - DNA, 19 bp, Artificial Sequence
  Description of Artificial Sequence: Synthetic primer
accttcttagaagtttctc

SEQ ID NO: 2430 - DNA, 20 bp, Artificial Sequence
  Description of Artificial Sequence: Synthetic primer
gagcactatgtattgttttc

SEQ ID NO: 2431 - DNA, 20 bp, Artificial Sequence
  Description of Artificial Sequence: Synthetic primer
ctgaaggagaagaagggaac

SEQ ID NO: 2432 - DNA, 19 bp, Artificial Sequence
  Description of Artificial Sequence: Synthetic primer
acaacatactcgtatctcc

SEQ ID NO: 2433 - DNA, 20 bp, Artificial Sequence
  Description of Artificial Sequence: Synthetic primer
gtattgaaaggtcagtggtg

SEQ ID NO: 2434 - DNA, 20 bp, Artificial Sequence
  Description of Artificial Sequence: Synthetic primer
cttttatatccttctcatgt

SEQ ID NO: 2435 - DNA, 18 bp, Artificial Sequence
  Description of Artificial Sequence: Synthetic primer
gagtagcaaagcatatga

SEQ ID NO: 2436 - DNA, 21 bp, Artificial Sequence
  Description of Artificial Sequence: Synthetic primer
ccagaaggccttcaaaataag

SEQ ID NO: 2437 - DNA, 19 bp, Artificial Sequence
  Description of Artificial Sequence: Synthetic primer
gagtagcaaagcatatgaa

SEQ ID NO: 2438 - DNA, 20 bp, Artificial Sequence
  Description of Artificial Sequence: Synthetic primer
ccatgtctttattagcaacc

SEQ ID NO: 2439 - DNA, 18 bp, Artificial Sequence
  Description of Artificial Sequence: Synthetic primer
cagagtatgaagcagttg

SEQ ID NO: 2440 - DNA, 20 bp, Artificial Sequence
  Description of Artificial Sequence: Synthetic primer
gctctagctctcaagctttg

SEQ ID NO: 2441 - DNA, 20 bp, Artificial Sequence
  Description of Artificial Sequence: Synthetic primer
tcccaaagggaattatcacc

SEQ ID NO: 2442 - DNA, 20 bp, Artificial Sequence
  Description of Artificial Sequence: Synthetic primer
ccaaagcttgagagctagag

SEQ ID NO: 2443 - DNA, 20 bp, Artificial Sequence
  Description of Artificial Sequence: Synthetic primer
attccctttgggaagaagtg

SEQ ID NO: 2444 - DNA, 20 bp, Artificial Sequence
  Description of Artificial Sequence: Synthetic primer
gctgccttacacagtctttt

SEQ ID NO: 2445 - DNA, 19 bp, Artificial Sequence
  Description of Artificial Sequence: Synthetic primer
tttggcctaaaaatgaggt

SEQ ID NO: 2446 - DNA, 19 bp, Artificial Sequence
  Description of Artificial Sequence: Synthetic primer
aaaaacctcatttttaggc

SEQ ID NO: 2447 - DNA, 19 bp, Artificial Sequence
  Description of Artificial Sequence: Synthetic primer
gaatgagcactgagccata

SEQ ID NO: 2448 - DNA, 21 bp, Artificial Sequence
  Description of Artificial Sequence: Synthetic primer
gatcaagttctaaatctcagg

SEQ ID NO: 2449 - DNA, 20 bp, Artificial Sequence
  Description of Artificial Sequence: Synthetic primer
cacatgtgtgaaaggcatgg

SEQ ID NO: 2450 - DNA, 20 bp, Artificial Sequence
  Description of Artificial Sequence: Synthetic primer
gttctacgctagaaatcaac

SEQ ID NO: 2451 - DNA, 19 bp, Artificial Sequence
  Description of Artificial Sequence: Synthetic primer
agaaggataggatttgtga

SEQ ID NO: 2452 - DNA, 20 bp, Artificial Sequence
  Description of Artificial Sequence: Synthetic primer
tctcacaaatcctatccttc

SEQ ID NO: 2453 - DNA, 20 bp, Artificial Sequence
  Description of Artificial Sequence: Synthetic primer
tggactagaaagaaggcagg

SEQ ID NO: 2454 - DNA, 20 bp, Artificial Sequence
  Description of Artificial Sequence: Synthetic primer
tcctgtacctgccttctttc

SEQ ID NO: 2455 - DNA, 20 bp, Artificial Sequence
  Description of Artificial Sequence: Synthetic primer
tcacacaaagcagtagcagg

SEQ ID NO: 2456 - DNA, 20 bp, Artificial Sequence
  Description of Artificial Sequence: Synthetic primer
tcctgctactgctttgtgtg

SEQ ID NO: 2457 - DNA, 20 bp, Artificial Sequence
  Description of Artificial Sequence: Synthetic primer
attggctgggaccatggtgt

SEQ ID NO: 2458 - DNA, 20 bp, Artificial Sequence
  Description of Artificial Sequence: Synthetic primer
tgctctattctgactgcctg

SEQ ID NO: 2459 - DNA, 20 bp, Artificial Sequence
  Description of Artificial Sequence: Synthetic primer
aacatcaacctgtaaccacc

SEQ ID NO: 2460 - DNA, 20 bp, Artificial Sequence
  Description of Artificial Sequence: Synthetic primer
gagagtaactgaaggaggtg

SEQ ID NO: 2461 - DNA, 20 bp, Artificial Sequence
  Description of Artificial Sequence: Synthetic primer
cacctccttcagttactctc

SEQ ID NO: 2462 - DNA, 20 bp, Artificial Sequence
  Description of Artificial Sequence: Synthetic primer
agaaataacatacccagggc

SEQ ID NO: 2463 - DNA, 20 bp, Artificial Sequence
  Description of Artificial Sequence: Synthetic primer
tatgcctagccctgggtatg

SEQ ID NO: 2464 - DNA, 20 bp, Artificial Sequence
  Description of Artificial Sequence: Synthetic primer
aggaaactggtcttcccttg

SEQ ID NO: 2465 - DNA, 19 bp, Artificial Sequence
  Description of Artificial Sequence: Synthetic primer
atggccgggctcggttagt

SEQ ID NO: 2466 - DNA, 20 bp, Artificial Sequence
  Description of Artificial Sequence: Synthetic primer
gtagcgtggcctttctgaac

SEQ ID NO: 2467 - DNA, 20 bp, Artificial Sequence
  Description of Artificial Sequence: Synthetic primer
gaatgttggccaagtggcag

SEQ ID NO: 2468 - DNA, 19 bp, Artificial Sequence
  Description of Artificial Sequence: Synthetic primer
ctctgtcagcaggaacaag

SEQ ID NO: 2469 - DNA, 20 bp, Artificial Sequence
  Description of Artificial Sequence: Synthetic primer
ccctagacttgttcctgctg

SEQ ID NO: 2470 - DNA, 20 bp, Artificial Sequence
  Description of Artificial Sequence: Synthetic primer
gggcaaatcagtgaagatca

SEQ ID NO: 2471 - DNA, 19 bp, Artificial Sequence
  Description of Artificial Sequence: Synthetic primer
gacacacaaacagcctgag

SEQ ID NO: 2472 - DNA, 20 bp, Artificial Sequence
  Description of Artificial Sequence: Synthetic primer
tccacacagtggttcttcag

SEQ ID NO: 2473 - DNA, 20 bp, Artificial Sequence
  Description of Artificial Sequence: Synthetic primer
atggtgtgtggcagtgtgag

SEQ ID NO: 2474 - DNA, 20 bp, Artificial Sequence
  Description of Artificial Sequence: Synthetic primer
agtgagaaggttgtcaccag

SEQ ID NO: 2475 - DNA, 20 bp, Artificial Sequence
  Description of Artificial Sequence: Synthetic primer
atccttcacctcctttgcac

SEQ ID NO: 2476 - DNA, 18 bp, Artificial Sequence
  Description of Artificial Sequence: Synthetic primer
gaggatgggtttatattg

SEQ ID NO: 2477 - DNA, 19 bp, Artificial Sequence
  Description of Artificial Sequence: Synthetic primer
gggcagatgtttcctctga

SEQ ID NO: 2478 - DNA, 19 bp, Artificial Sequence
  Description of Artificial Sequence: Synthetic primer
ctgccaacaccgcaccctt

SEQ ID NO: 2479 - DNA, 20 bp, Artificial Sequence
  Description of Artificial Sequence: Synthetic primer
gagacagtcactatatgaca

SEQ ID NO: 2480 - DNA, 20 bp, Artificial Sequence
  Description of Artificial Sequence: Synthetic primer
aaccagggactccacccttc

SEQ ID NO: 2481 - DNA, 19 bp, Artificial Sequence
  Description of Artificial Sequence: Synthetic primer
tgtaggagccgaggtggag

SEQ ID NO: 2482 - DNA, 18 bp, Artificial Sequence
  Description of Artificial Sequence: Synthetic primer
ctggctctggcgagccct

SEQ ID NO: 2483 - DNA, 20 bp, Artificial Sequence
  Description of Artificial Sequence: Synthetic primer
ctgaagtttcactcgctgtc

SEQ ID NO: 2484 - DNA, 21 bp, Artificial Sequence
  Description of Artificial Sequence: Synthetic primer
cagtcaagtaaaaagaaacgc

SEQ ID NO: 2485 - DNA, 20 bp, Artificial Sequence
  Description of Artificial Sequence: Synthetic primer
agaaacgcaactaaaagagc

SEQ ID NO: 2486 - DNA, 19 bp, Artificial Sequence
  Description of Artificial Sequence: Synthetic primer
taacctaagcagaattttc

SEQ ID NO: 2487 - DNA, 19 bp, Artificial Sequence
  Description of Artificial Sequence: Synthetic primer
ctgctgaagccctattttg

SEQ ID NO: 2488 - DNA, 20 bp, Artificial Sequence
  Description of Artificial Sequence: Synthetic primer
gggaaatttcaaaatagggc

SEQ ID NO: 2489 - DNA, 20 bp, Artificial Sequence
  Description of Artificial Sequence: Synthetic primer
ctcaccacctggaagtgagt

SEQ ID NO: 2490 - DNA, 19 bp, Artificial Sequence
  Description of Artificial Sequence: Synthetic primer
ctgaccgggagctgagaag

SEQ ID NO: 2491 - DNA, 20 bp, Artificial Sequence
  Description of Artificial Sequence: Synthetic primer
tacctggagacagaaacagc

SEQ ID NO: 2492 - DNA, 18 bp, Artificial Sequence
  Description of Artificial Sequence: Synthetic primer
cacacagcagcctggtgg

SEQ ID NO: 2493 - DNA, 20 bp, Artificial Sequence
  Description of Artificial Sequence: Synthetic primer
ttctctccttctataatggc

SEQ ID NO: 2494 - DNA, 20 bp, Artificial Sequence
  Description of Artificial Sequence: Synthetic primer
ggaatatctccttggccttc

SEQ ID NO: 2495 - DNA, 20 bp, Artificial Sequence
  Description of Artificial Sequence: Synthetic primer
aggacccaccctggctctca

SEQ ID NO: 2496 - DNA, 20 bp, Artificial Sequence
  Description of Artificial Sequence: Synthetic primer
tattggagagtccgcatgag

SEQ ID NO: 2497 - DNA, 20 bp, Artificial Sequence
  Description of Artificial Sequence: Synthetic primer
tgctccatgctcaccatcag

SEQ ID NO: 2498 - DNA, 20 bp, Artificial Sequence
  Description of Artificial Sequence: Synthetic primer
tttaccacagctattccccc

SEQ ID NO: 2499 - DNA, 20 bp, Artificial Sequence
  Description of Artificial Sequence: Synthetic primer
ggtccagaaatagctacagg

SEQ ID NO: 2500 - DNA, 20 bp, Artificial Sequence
  Description of Artificial Sequence: Synthetic primer
ttccttgcctggatgatttc

SEQ ID NO: 2501 - DNA, 20 bp, Artificial Sequence
  Description of Artificial Sequence: Synthetic primer
agaaagcagaggtttaggag

SEQ ID NO: 2502 - DNA, 20 bp, Artificial Sequence
  Description of Artificial Sequence: Synthetic primer
gtctctcaccccttcatttt

SEQ ID NO: 2503 - DNA, 20 bp, Artificial Sequence
  Description of Artificial Sequence: Synthetic primer
gatttgcttgccaataggag

SEQ ID NO: 2504 - DNA, 20 bp, Artificial Sequence
  Description of Artificial Sequence: Synthetic primer
ctgtctctcaccccttcatt

SEQ ID NO: 2505 - DNA, 20 bp, Artificial Sequence
  Description of Artificial Sequence: Synthetic primer
gcagcgtgattcctatgaag

SEQ ID NO: 2506 - DNA, 23 bp, Artificial Sequence
  Description of Artificial Sequence: Synthetic primer
taagtgacctgcttctcagctgt

SEQ ID NO: 2507 - DNA, 22 bp, Artificial Sequence
  Description of Artificial Sequence: Synthetic primer
tgttacagccaatatttaagga

SEQ ID NO: 2508 - DNA, 25 bp, Artificial Sequence
  Description of Artificial Sequence: Synthetic primer
ctcttgctgtctaatagaagcttac

SEQ ID NO: 2509 - DNA, 17 bp, Artificial Sequence
  Description of Artificial Sequence: Synthetic primer
ttttaccagtgctcccc

SEQ ID NO: 2510 - DNA, 18 bp, Artificial Sequence
  Description of Artificial Sequence: Synthetic primer
atagaatgcccatttgtg

SEQ ID NO: 2511 - DNA, 18 bp, Artificial Sequence
  Description of Artificial Sequence: Synthetic primer
tcagaagaaaataggcca

SEQ ID NO: 2512 - DNA, 21 bp, Artificial Sequence
  Description of Artificial Sequence: Synthetic primer
caaggttgaaattgggaatgt

SEQ ID NO: 2513 - DNA, 18 bp, Artificial Sequence
  Description of Artificial Sequence: Synthetic primer
ttcaaccttgctgaaaaa

SEQ ID NO: 2514 - DNA, 20 bp, Artificial Sequence
  Description of Artificial Sequence: Synthetic primer
tgtatcctagctgttcttaa

SEQ ID NO: 2515 - DNA, 21 bp, Artificial Sequence
  Description of Artificial Sequence: Synthetic primer
ttgaaatctaccaaactgtaa

SEQ ID NO: 2516 - DNA, 21 bp, Artificial Sequence
  Description of Artificial Sequence: Synthetic primer
ggaacaaaatcttacaaaagg

SEQ ID NO: 2517 - DNA, 17 bp, Artificial Sequence
  Description of Artificial Sequence: Synthetic primer
gggattaggcactcgct

SEQ ID NO: 2518 - DNA, 24 bp, Artificial Sequence
  Description of Artificial Sequence: Synthetic primer
gggtaacatatctttggtatggtt

SEQ ID NO: 2519 - DNA, 19 bp, Artificial Sequence
  Description of Artificial Sequence: Synthetic primer
gtggcaaaatacctcaaga

SEQ ID NO: 2520 - DNA, 21 bp, Artificial Sequence
  Description of Artificial Sequence: Synthetic primer
atttttcatacacttctctgg

SEQ ID NO: 2521 - DNA, 23 bp, Artificial Sequence
  Description of Artificial Sequence: Synthetic primer
accattagtggtttgattttaat

SEQ ID NO: 2522 - DNA, 24 bp, Artificial Sequence
  Description of Artificial Sequence: Synthetic primer
actcactttccattaattctgtgt

SEQ ID NO: 2523 - DNA, 22 bp, Artificial Sequence
  Description of Artificial Sequence: Synthetic primer
tttgttacttttcttttccccc

SEQ ID NO: 2524 - DNA, 21 bp, Artificial Sequence
  Description of Artificial Sequence: Synthetic primer
gtttattaatgcagagctctc

SEQ ID NO: 2525 - DNA, 17 bp, Artificial Sequence
  Description of Artificial Sequence: Synthetic primer
tctcagaatttccctgg

SEQ ID NO: 2526 - DNA, 26 bp, Artificial Sequence
  Description of Artificial Sequence: Synthetic primer
tactcaaatcaaattggcttacttgc

SEQ ID NO: 2527 - DNA, 21 bp, Artificial Sequence
  Description of Artificial Sequence: Synthetic primer
gccaacatccatgaaaaacaa

SEQ ID NO: 2528 - DNA, 26 bp, Artificial Sequence
  Description of Artificial Sequence: Synthetic primer
ccagccaagaatacaaacacaaaata

SEQ ID NO: 2529 - DNA, 22 bp, Artificial Sequence
  Description of Artificial Sequence: Synthetic primer
tgatgttttcttattctcctta

SEQ ID NO: 2530 - DNA, 25 bp, Artificial Sequence
  Description of Artificial Sequence: Synthetic primer
ggtgaaggctgtatttgtagtagta

SEQ ID NO: 2531 - DNA, 21 bp, Artificial Sequence
  Description of Artificial Sequence: Synthetic primer
gccttaactccagagttttct

SEQ ID NO: 2532 - DNA, 17 bp, Artificial Sequence
  Description of Artificial Sequence: Synthetic primer
tttgaagctattccccg

SEQ ID NO: 2533 - DNA, 18 bp, Artificial Sequence
  Description of Artificial Sequence: Synthetic primer
catagaaagggcagtaga

SEQ ID NO: 2534 - DNA, 27 bp, Artificial Sequence
  Description of Artificial Sequence: Synthetic primer
gtctgccactttgccacctgttactac

SEQ ID NO: 2535 - DNA, 26 bp, Artificial Sequence
  Description of Artificial Sequence: Synthetic primer
accagtatcagcaatagctttgactt

SEQ ID NO: 2536 - DNA, 19 bp, Artificial Sequence
  Description of Artificial Sequence: Synthetic primer
catctctacttcgtacctc

SEQ ID NO: 2537 - DNA, 24 bp, Artificial Sequence
  Description of Artificial Sequence: Synthetic primer
gaagtagagatgagacttcatcaa

SEQ ID NO: 2538 - DNA, 19 bp, Artificial Sequence
  Description of Artificial Sequence: Synthetic primer
aggttttttgcagaacaac

SEQ ID NO: 2539 - DNA, 24 bp, Artificial Sequence
  Description of Artificial Sequence: Synthetic primer
ggtcatagaaggttatgaaatagc

SEQ ID NO: 2540 - DNA, 18 bp, Artificial Sequence
  Description of Artificial Sequence: Synthetic primer
aagattttcctccctcct

SEQ ID NO: 2541 - DNA, 21 bp, Artificial Sequence
  Description of Artificial Sequence: Synthetic primer
aggagggaggaaaatctttaa

SEQ ID NO: 2542 - DNA, 20 bp, Artificial Sequence
  Description of Artificial Sequence: Synthetic primer
ctccttcttctacccacaga

SEQ ID NO: 2543 - DNA, 18 bp, Artificial Sequence
  Description of Artificial Sequence: Synthetic primer
ttgatcgccttaatctga

SEQ ID NO: 2544 - DNA, 17 bp, Artificial Sequence
  Description of Artificial Sequence: Synthetic primer
cgatcaagaacaccctt

SEQ ID NO: 2545 - DNA, 22 bp, Artificial Sequence
  Description of Artificial Sequence: Synthetic primer
aggctcaattacttgaaatagc

SEQ ID NO: 2546 - DNA, 26 bp, Artificial Sequence
  Description of Artificial Sequence: Synthetic primer
ggtggaggtgcaggctttaggtttgg

SEQ ID NO: 2547 - DNA, 21 bp, Artificial Sequence
  Description of Artificial Sequence: Synthetic primer
gagaaagttgctaaaaagtca

SEQ ID NO: 2548 - DNA, 24 bp, Artificial Sequence
  Description of Artificial Sequence: Synthetic primer
tgatacagggaattcttttgttaa

SEQ ID NO: 2549 - DNA, 20 bp, Artificial Sequence
  Description of Artificial Sequence: Synthetic primer
tatcatctggatctcaacat

SEQ ID NO: 2550 - DNA, 27 bp, Artificial Sequence
  Description of Artificial Sequence: Synthetic primer
tgcattctcactgagtcttttctgagc

SEQ ID NO: 2551 - DNA, 23 bp, Artificial Sequence
  Description of Artificial Sequence: Synthetic primer
agactcagtgagaatgcatttga

SEQ ID NO: 2552 - DNA, 17 bp, Artificial Sequence
  Description of Artificial Sequence: Synthetic primer
gtgtctgctttgatgga

SEQ ID NO: 2553 - DNA, 19 bp, Artificial Sequence
  Description of Artificial Sequence: Synthetic primer
caggtggttgccaccttct

SEQ ID NO: 2554 - DNA, 17 bp, Artificial Sequence
  Description of Artificial Sequence: Synthetic primer
ctcatggctaatgccac

SEQ ID NO: 2555 - DNA, 26 bp, Artificial Sequence
  Description of Artificial Sequence: Synthetic primer
agacattgtgtaaaaagcaatctgta

SEQ ID NO: 2556 - DNA, 25 bp, Artificial Sequence
  Description of Artificial Sequence: Synthetic primer
ggttttggtatgtttatattgttta

SEQ ID NO: 2557 - DNA, 23 bp, Artificial Sequence
  Description of Artificial Sequence: Synthetic primer
cattccacactgaagattactct

SEQ ID NO: 2558 - DNA, 22 bp, Artificial Sequence
  Description of Artificial Sequence: Synthetic primer
ttacaggcaagtgttacagtag

SEQ ID NO: 2559 - DNA, 19 bp, Artificial Sequence
  Description of Artificial Sequence: Synthetic primer
atctgtccagcagaaccca

SEQ ID NO: 2560 - DNA, 17 bp, Artificial Sequence
  Description of Artificial Sequence: Synthetic primer
gttctgctggacagata

SEQ ID NO: 2561 - DNA, 21 bp, Artificial Sequence
  Description of Artificial Sequence: Synthetic primer
agtgttattgaggtgatcaag

SEQ ID NO: 2562 - DNA, 22 bp, Artificial Sequence
  Description of Artificial Sequence: Synthetic primer
caaaattttgaggggagatggt

SEQ ID NO: 2563 - DNA, 23 bp, Artificial Sequence
  Description of Artificial Sequence: Synthetic primer
agggagtaaaaaatgaagtctga

SEQ ID NO: 2564 - DNA, 19 bp, Artificial Sequence
  Description of Artificial Sequence: Synthetic primer
cagctacacctagatagac

SEQ ID NO: 2565 - DNA, 23 bp, Artificial Sequence
  Description of Artificial Sequence: Synthetic primer
ccactgtaatacacatgaaatat

SEQ ID NO: 2566 - DNA, 26 bp, Artificial Sequence
  Description of Artificial Sequence: Synthetic primer
attacagtggtattcatatgctatgt

SEQ ID NO: 2567 - DNA, 18 bp, Artificial Sequence
  Description of Artificial Sequence: Synthetic primer
ctgacagcttctctgtaa

SEQ ID NO: 2568 - DNA, 17 bp, Artificial Sequence
  Description of Artificial Sequence: Synthetic primer
ggtttgaagcagtcaca

SEQ ID NO: 2569 - DNA, 23 bp, Artificial Sequence
  Description of Artificial Sequence: Synthetic primer
ctcagtagaggtttagtatgatg

SEQ ID NO: 2570 - DNA, 23 bp, Artificial Sequence
  Description of Artificial Sequence: Synthetic primer
ttgtttcttagtgctctagccat

SEQ ID NO: 2571 - DNA, 26 bp, Artificial Sequence
  Description of Artificial Sequence: Synthetic primer
catagtcactggtccatagtaagtat

SEQ ID NO: 2572 - DNA, 26 bp, Artificial Sequence
  Description of Artificial Sequence: Synthetic primer
agttcccagaaaagaagaggaatgtg

SEQ ID NO: 2573 - DNA, 20 bp, Artificial Sequence
  Description of Artificial Sequence: Synthetic primer
aaaaagtgcaccttttctta

SEQ ID NO: 2574 - DNA, 17 bp, Artificial Sequence
  Description of Artificial Sequence: Synthetic primer
tggggaaagaacttgaa

SEQ ID NO: 2575 - DNA, 23 bp, Artificial Sequence
  Description of Artificial Sequence: Synthetic primer
ccaaacttttctcacctatgttt

SEQ ID NO: 2576 - DNA, 25 bp, Artificial Sequence
  Description of Artificial Sequence: Synthetic primer
cttcttctttataggaacacattgc

SEQ ID NO: 2577 - DNA, 19 bp, Artificial Sequence
  Description of Artificial Sequence: Synthetic primer
tttagctctagaggatgag

SEQ ID NO: 2578 - DNA, 18 bp, Artificial Sequence
  Description of Artificial Sequence: Synthetic primer
acatccatcctcaaactg

SEQ ID NO: 2579 - DNA, 17 bp, Artificial Sequence
  Description of Artificial Sequence: Synthetic primer
gctttttccaccttgaa

SEQ ID NO: 2580 - DNA, 21 bp, Artificial Sequence
  Description of Artificial Sequence: Synthetic primer
ttgagcacactgcaaagtcat

SEQ ID NO: 2581 - DNA, 17 bp, Artificial Sequence
  Description of Artificial Sequence: Synthetic primer
cagctcccctacatacc

SEQ ID NO: 2582 - DNA, 27 bp, Artificial Sequence
  Description of Artificial Sequence: Synthetic primer
ggaattctccttggactcttttgtctc

SEQ ID NO: 2583 - DNA, 27 bp, Artificial Sequence
  Description of Artificial Sequence: Synthetic primer
ctcttatccagttcagctttgtttgtc

SEQ ID NO: 2584 - DNA, 26 bp, Artificial Sequence
  Description of Artificial Sequence: Synthetic primer
gaggagatatggtgcagagctctcag

SEQ ID NO: 2585 - DNA, 26 bp, Artificial Sequence
  Description of Artificial Sequence: Synthetic primer
ttcaaatgcacctagtgtcacaagaa

SEQ ID NO: 2586 - DNA, 26 bp, Artificial Sequence
  Description of Artificial Sequence: Synthetic primer
ggaaagggaaaaaaacctgcagcata

SEQ ID NO: 2587 - DNA, 24 bp, Artificial Sequence
  Description of Artificial Sequence: Synthetic primer
ccagaaggaggccctggtgtacta

SEQ ID NO: 2588 - DNA, 23 bp, Artificial Sequence
  Description of Artificial Sequence: Synthetic primer
cagaatcatagagtaaaaattgc

SEQ ID NO: 2589 - DNA, 19 bp, Artificial Sequence
  Description of Artificial Sequence: Synthetic primer
aaatatgcctactccacaa

SEQ ID NO: 2590 - DNA, 20 bp, Artificial Sequence
  Description of Artificial Sequence: Synthetic primer
gagcctaaaggcaggatgtg

SEQ ID NO: 2591 - DNA, 22 bp, Artificial Sequence
  Description of Artificial Sequence: Synthetic primer
tgtcacttaaggtcttagactg

SEQ ID NO: 2592 - DNA, 21 bp, Artificial Sequence
  Description of Artificial Sequence: Synthetic primer
ctaacagctcaaggaatgtat

SEQ ID NO: 2593 - DNA, 21 bp, Artificial Sequence
  Description of Artificial Sequence: Synthetic primer
ctgcaaccatgttgttttatt

SEQ ID NO: 2594 - DNA, 26 bp, Artificial Sequence
  Description of Artificial Sequence: Synthetic primer
acatggttgcaggtaatggcaacaag

SEQ ID NO: 2595 - DNA, 20 bp, Artificial Sequence
  Description of Artificial Sequence: Synthetic primer
ccattcccattcccaccttt

SEQ ID NO: 2596 - DNA, 23 bp, Artificial Sequence
  Description of Artificial Sequence: Synthetic primer
tgctaaaaaggactgttatctaa

SEQ ID NO: 2597 - DNA, 23 bp, Artificial Sequence
  Description of Artificial Sequence: Synthetic primer
ggaatagtacaataagataagga

SEQ ID NO: 2598 - DNA, 18 bp, Artificial Sequence
  Description of Artificial Sequence: Synthetic primer
aatcagtctgggaaggca

SEQ ID NO: 2599 - DNA, 25 bp, Artificial Sequence
  Description of Artificial Sequence: Synthetic primer
tatacagagaggacagtggtaaact

SEQ ID NO: 2600 - DNA, 24 bp, Artificial Sequence
  Description of Artificial Sequence: Synthetic primer
gctgccctttctatatgatgtaat

SEQ ID NO: 2601 - DNA, 26 bp, Artificial Sequence
  Description of Artificial Sequence: Synthetic primer
acataaaatgttaccaaacagatggg

SEQ ID NO: 2602 - DNA, 23 bp, Artificial Sequence
  Description of Artificial Sequence: Synthetic primer
gaatcttagtgtggaaaaaaaaa

SEQ ID NO: 2603 - DNA, 25 bp, Artificial Sequence
  Description of Artificial Sequence: Synthetic primer
gaaaagattatgatgcactggcctg

SEQ ID NO: 2604 - DNA, 18 bp, Artificial Sequence
  Description of Artificial Sequence: Synthetic primer
gatgaatgcagtgaagtc

SEQ ID NO: 2605 - DNA, 20 bp, Artificial Sequence
  Description of Artificial Sequence: Synthetic primer
acttcactgcattcatcagc

SEQ ID NO: 2606 - DNA, 20 bp, Artificial Sequence
  Description of Artificial Sequence: Synthetic primer
aaaaaagtgcatgtctttgt

SEQ ID NO: 2607 - DNA, 19 bp, Artificial Sequence
  Description of Artificial Sequence: Synthetic primer
tagggatcagaatctcaac

SEQ ID NO: 2608 - DNA, 18 bp, Artificial Sequence
  Description of Artificial Sequence: Synthetic primer
ggcaacatgcatatagag

SEQ ID NO: 2609 - DNA, 21 bp, Artificial Sequence
  Description of Artificial Sequence: Synthetic primer
ttaggcacaaatggaaatagt

SEQ ID NO: 2610 - DNA, 22 bp, Artificial Sequence
  Description of Artificial Sequence: Synthetic primer
gacaactttttctttttcttct

SEQ ID NO: 2611 - DNA, 25 bp, Artificial Sequence
  Description of Artificial Sequence: Synthetic primer
aaacaatgggttctagaaaaaaaaa

SEQ ID NO: 2612 - DNA, 24 bp, Artificial Sequence
  Description of Artificial Sequence: Synthetic primer
tttagtattgaatttagtgcttag

SEQ ID NO: 2613 - DNA, 20 bp, Artificial Sequence
  Description of Artificial Sequence: Synthetic primer
ccccttcatctgggactcaa

SEQ ID NO: 2614 - DNA, 19 bp, Artificial Sequence
  Description of Artificial Sequence: Synthetic primer
ctcagatacctgcatgtca

SEQ ID NO: 2615 - DNA, 22 bp, Artificial Sequence
  Description of Artificial Sequence: Synthetic primer
ttttgtttcatttttgtcacat

SEQ ID NO: 2616 - DNA, 24 bp, Artificial Sequence
  Description of Artificial Sequence: Synthetic primer
atttacagtttatgtgtcagctac

SEQ ID NO: 2617 - DNA, 26 bp, Artificial Sequence
  Description of Artificial Sequence: Synthetic primer
tagcaaagaataatcatatcaatttc

SEQ ID NO: 2618 - DNA, 17 bp, Artificial Sequence
  Description of Artificial Sequence: Synthetic primer
aactggcaaactctgat

SEQ ID NO: 2619 - DNA, 21 bp, Artificial Sequence
  Description of Artificial Sequence: Synthetic primer
aggaacaggacattaaaaaaa

SEQ ID NO: 2620 - DNA, 20 bp, Artificial Sequence
  Description of Artificial Sequence: Synthetic primer
aggacacctatgactaggaa

SEQ ID NO: 2621 - DNA, 26 bp, Artificial Sequence
  Description of Artificial Sequence: Synthetic primer
aatgaatctgccagatctgtgaatga

SEQ ID NO: 2622 - DNA, 26 bp, Artificial Sequence
  Description of Artificial Sequence: Synthetic primer
aggacaaattaaagaaagtaatttat

SEQ ID NO: 2623 - DNA, 22 bp, Artificial Sequence
  Description of Artificial Sequence: Synthetic primer
gagttccataagtttactcttc

SEQ ID NO: 2624 - DNA, 17 bp, Artificial Sequence
  Description of Artificial Sequence: Synthetic primer
cacacctgggtccctgc

SEQ ID NO: 2625 - DNA, 17 bp, Artificial Sequence
  Description of Artificial Sequence: Synthetic primer
cagttgttaagccagac

SEQ ID NO: 2626 - DNA, 17 bp, Artificial Sequence
  Description of Artificial Sequence: Synthetic primer
gcagggctatgcgggag

SEQ ID NO: 2627 - DNA, 25 bp, Artificial Sequence
  Description of Artificial Sequence: Synthetic primer
aaatgaagtgcaggaaagccctgtg

SEQ ID NO: 2628 - DNA, 17 bp, Artificial Sequence
  Description of Artificial Sequence: Synthetic primer
cccacggcggcctcacc

SEQ ID NO: 2629 - DNA, 17 bp, Artificial Sequence
  Description of Artificial Sequence: Synthetic primer
agctcgggcgccccacc

SEQ ID NO: 2630 - DNA, 20 bp, Artificial Sequence
  Description of Artificial Sequence: Synthetic primer
catctgcccatcccatctgc

SEQ ID NO: 2631 - DNA, 17 bp, Artificial Sequence
  Description of Artificial Sequence: Synthetic primer
tccacacaccgccctgc

SEQ ID NO: 2632 - DNA, 19 bp, Artificial Sequence
  Description of Artificial Sequence: Synthetic primer
tctctgtcagtttctccat

SEQ ID NO: 2633 - DNA, 25 bp, Artificial Sequence
  Description of Artificial Sequence: Synthetic primer
ggaactctcatttatcaccaaacca

SEQ ID NO: 2634 - DNA, 19 bp, Artificial Sequence
  Description of Artificial Sequence: Synthetic primer
gggccctcctttccacttc

SEQ ID NO: 2635 - DNA, 19 bp, Artificial Sequence
  Description of Artificial Sequence: Synthetic primer
cgcgcgagtgtggaagaaa

SEQ ID NO: 2636 - DNA, 17 bp, Artificial Sequence
  Description of Artificial Sequence: Synthetic primer
cctcctccctcgctctc

SEQ ID NO: 2637 - DNA, 21 bp, Artificial Sequence
  Description of Artificial Sequence: Synthetic primer
aaaacgccctgtgagctctcc

SEQ ID NO: 2638 - DNA, 25 bp, Artificial Sequence
  Description of Artificial Sequence: Synthetic primer
ctctccttgctaataatgtcccaca

SEQ ID NO: 2639 - DNA, 17 bp, Artificial Sequence
  Description of Artificial Sequence: Synthetic primer
gctccacctgccgagtc

SEQ ID NO: 2640 - DNA, 18 bp, Artificial Sequence
  Description of Artificial Sequence: Synthetic primer
gggcagggaaacctgccg

SEQ ID NO: 2641 - DNA, 19 bp, Artificial Sequence
  Description of Artificial Sequence: Synthetic primer
ctgtggggcggggctggtc

SEQ ID NO: 2642 - DNA, 20 bp, Artificial Sequence
  Description of Artificial Sequence: Synthetic primer
gaccagccccgccccacagg

SEQ ID NO: 2643 - DNA, 17 bp, Artificial Sequence
  Description of Artificial Sequence: Synthetic primer
gctcgcaataggccccc

SEQ ID NO: 2644 - DNA, 19 bp, Artificial Sequence
  Description of Artificial Sequence: Synthetic primer
ctggggtgcccccgtcctc

SEQ ID NO: 2645 - DNA, 18 bp, Artificial Sequence
  Description of Artificial Sequence: Synthetic primer
gggcctggatgctgggtg

SEQ ID NO: 2646 - DNA, 26 bp, Artificial Sequence
  Description of Artificial Sequence: Synthetic primer
ccagattcctgaagaggggatgacta

SEQ ID NO: 2647 - DNA, 26 bp, Artificial Sequence
  Description of Artificial Sequence: Synthetic primer
gagcaagaggaggaggctcggcccag

SEQ ID NO: 2648 - DNA, 25 bp, Artificial Sequence
  Description of Artificial Sequence: Synthetic primer
ggccagtttatgaaagtcaagccta

SEQ ID NO: 2649 - DNA, 21 bp, Artificial Sequence
  Description of Artificial Sequence: Synthetic primer
gggtggaggtgctccaggact

SEQ ID NO: 2650 - DNA, 19 bp, Artificial Sequence
  Description of Artificial Sequence: Synthetic primer
cccaccccgtcacgcgcat

SEQ ID NO: 2651 - DNA, 22 bp, Artificial Sequence
  Description of Artificial Sequence: Synthetic primer
ctggtgtaggcgtggggtggac

SEQ ID NO: 2652 - DNA, 21 bp, Artificial Sequence
  Description of Artificial Sequence: Synthetic primer
gtctctgggggtcagtgtctg

SEQ ID NO: 2653 - DNA, 17 bp, Artificial Sequence
  Description of Artificial Sequence: Synthetic primer
ccccaggctcctccccc

SEQ ID NO: 2654 - DNA, 19 bp, Artificial Sequence
  Description of Artificial Sequence: Synthetic primer
ttttgattggcctcacaag

SEQ ID NO: 2655 - DNA, 23 bp, Artificial Sequence
  Description of Artificial Sequence: Synthetic primer
aacatttagaacagtacttgtaa

SEQ ID NO: 2656 - DNA, 17 bp, Artificial Sequence
  Description of Artificial Sequence: Synthetic primer
tgctgtcaggatttcca

SEQ ID NO: 2657 - DNA, 17 bp, Artificial Sequence
  Description of Artificial Sequence: Synthetic primer
gcttccttcagccagtc

SEQ ID NO: 2658 - DNA, 20 bp, Artificial Sequence
  Description of Artificial Sequence: Synthetic primer
gcatggtgatctggagctag

SEQ ID NO: 2659 - DNA, 26 bp, Artificial Sequence
  Description of Artificial Sequence: Synthetic primer
tggcccgaagggtagcaatgattgat

SEQ ID NO: 2660 - DNA, 20 bp, Artificial Sequence
  Description of Artificial Sequence: Synthetic primer
gccagtttttgaacagcata

SEQ ID NO: 2661 - DNA, 18 bp, Artificial Sequence
  Description of Artificial Sequence: Synthetic primer
gtgaagagacccttagag

SEQ ID NO: 2662 - DNA, 17 bp, Artificial Sequence
  Description of Artificial Sequence: Synthetic primer
cttcactgtacacccca

SEQ ID NO: 2663 - DNA, 22 bp, Artificial Sequence
  Description of Artificial Sequence: Synthetic primer
agggactctggagggatagctg

SEQ ID NO: 2664 - DNA, 19 bp, Artificial Sequence
  Description of Artificial Sequence: Synthetic primer
aagacctcatctgcagaaa

SEQ ID NO: 2665 - DNA, 20 bp, Artificial Sequence
  Description of Artificial Sequence: Synthetic primer
aagaggaagccagaaaagcc

SEQ ID NO: 2666 - DNA, 21 bp, Artificial Sequence
  Description of Artificial Sequence: Synthetic primer
tactgatgatctgaactccct

SEQ ID NO: 2667 - DNA, 17 bp, Artificial Sequence
  Description of Artificial Sequence: Synthetic primer
ggccaagcctcatataa

SEQ ID NO: 2668 - DNA, 17 bp, Artificial Sequence
  Description of Artificial Sequence: Synthetic primer
tctgaggcaaactgcaa

SEQ ID NO: 2669 - DNA, 24 bp, Artificial Sequence
  Description of Artificial Sequence: Synthetic primer
aaatctctagtgtatcagaagtaa

SEQ ID NO: 2670 - DNA, 22 bp, Artificial Sequence
  Description of Artificial Sequence: Synthetic primer
tttggcaatggaacattataag

SEQ ID NO: 2671 - DNA, 27 bp, Artificial Sequence
  Description of Artificial Sequence: Synthetic primer
ataccttactcagacaaactcttcgag

SEQ ID NO: 2672 - DNA, 23 bp, Artificial Sequence
  Description of Artificial Sequence: Synthetic primer
tacctagatgattgcttctaaat

SEQ ID NO: 2673 - DNA, 22 bp, Artificial Sequence
  Description of Artificial Sequence: Synthetic primer
acattgttggtccaatactaat

SEQ ID NO: 2674 - DNA, 18 bp, Artificial Sequence
  Description of Artificial Sequence: Synthetic primer
accagtggttctggctcc

SEQ ID NO: 2675 - DNA, 23 bp, Artificial Sequence
  Description of Artificial Sequence: Synthetic primer
tgagttacaaagattatgacaag

SEQ ID NO: 2676 - DNA, 25 bp, Artificial Sequence
  Description of Artificial Sequence: Synthetic primer
tgacaaattgccaaatcatgtctta

SEQ ID NO: 2677 - DNA, 21 bp, Artificial Sequence
  Description of Artificial Sequence: Synthetic primer
ataacagtgggctttcacaat

SEQ ID NO: 2678 - DNA, 22 bp, Artificial Sequence
  Description of Artificial Sequence: Synthetic primer
actccccaagtgtccgcacccc

SEQ ID NO: 2679 - DNA, 17 bp, Artificial Sequence
  Description of Artificial Sequence: Synthetic primer
ggtgtgaggagattctt

SEQ ID NO: 2680 - DNA, 22 bp, Artificial Sequence
  Description of Artificial Sequence: Synthetic primer
aaggaatcattctgagtgaaaa

SEQ ID NO: 2681 - DNA, 17 bp, Artificial Sequence
  Description of Artificial Sequence: Synthetic primer
agggaggagactcagaa

SEQ ID NO: 2682 - DNA, 27 bp, Artificial Sequence
  Description of Artificial Sequence: Synthetic primer
tctagccctttaaatacatttgacaat

SEQ ID NO: 2683 - DNA, 25 bp, Artificial Sequence
  Description of Artificial Sequence: Synthetic primer
aattagaaatctagtgcaaaagaat

SEQ ID NO: 2684 - DNA, 24 bp, Artificial Sequence
  Description of Artificial Sequence: Synthetic primer
ataatacttagttttggtcatcaa

SEQ ID NO: 2685 - DNA, 27 bp, Artificial Sequence
  Description of Artificial Sequence: Synthetic primer
cttcacctgataatttttcaccatttt

SEQ ID NO: 2686 - DNA, 19 bp, Artificial Sequence
  Description of Artificial Sequence: Synthetic primer
gtgcagaaaagtgaatcca

SEQ ID NO: 2687 - DNA, 17 bp, Artificial Sequence
  Description of Artificial Sequence: Synthetic primer
ctggccagcacttttga

SEQ ID NO: 2688 - DNA, 22 bp, Artificial Sequence
  Description of Artificial Sequence: Synthetic primer
acctttggtgtctttatccctg

SEQ ID NO: 2689 - DNA, 24 bp, Artificial Sequence
  Description of Artificial Sequence: Synthetic primer
caagcttaaaatgtgggcctagat

SEQ ID NO: 2690 - DNA, 26 bp, Artificial Sequence
  Description of Artificial Sequence: Synthetic primer
aaaacttagctgaaaggaacatgaaa

SEQ ID NO: 2691 - DNA, 26 bp, Artificial Sequence
  Description of Artificial Sequence: Synthetic primer
gagactattaaggaaatataaaatga

SEQ ID NO: 2692 - DNA, 25 bp, Artificial Sequence
  Description of Artificial Sequence: Synthetic primer
cataaaatgtgtagtatttcttaga

SEQ ID NO: 2693 - DNA, 25 bp, Artificial Sequence
  Description of Artificial Sequence: Synthetic primer
aagaaatactacacattttatgtta

SEQ ID NO: 2694 - DNA, 19 bp, Artificial Sequence
  Description of Artificial Sequence: Synthetic primer
ctcctcccataaaggaaga

SEQ ID NO: 2695 - DNA, 25 bp, Artificial Sequence
  Description of Artificial Sequence: Synthetic primer
agtttctttctatgtctttggttat

SEQ ID NO: 2696 - DNA, 19 bp, Artificial Sequence
  Description of Artificial Sequence: Synthetic primer
cttccagaaggagctgccc

SEQ ID NO: 2697 - DNA, 17 bp, Artificial Sequence
  Description of Artificial Sequence: Synthetic primer
aaccacagctggaacac

SEQ ID NO: 2698 - DNA, 18 bp, Artificial Sequence
  Description of Artificial Sequence: Synthetic primer
atggtgtcctccatgcag

SEQ ID NO: 2699 - DNA, 17 bp, Artificial Sequence
  Description of Artificial Sequence: Synthetic primer
ggtgatccagacactct

SEQ ID NO: 2700 - DNA, 27 bp, Artificial Sequence
  Description of Artificial Sequence: Synthetic primer
acagcctcaggccacgacttctgtgct

SEQ ID NO: 2701 - DNA, 17 bp, Artificial Sequence
  Description of Artificial Sequence: Synthetic primer
ctggtcttggcagatgg

SEQ ID NO: 2702 - DNA, 17 bp, Artificial Sequence
  Description of Artificial Sequence: Synthetic primer
tctgacctagctccctt

SEQ ID NO: 2703 - DNA, 18 bp, Artificial Sequence
  Description of Artificial Sequence: Synthetic primer
tcagagacaacttgaaca

SEQ ID NO: 2704 - DNA, 21 bp, Artificial Sequence
  Description of Artificial Sequence: Synthetic primer
gccacattctcgataagtagt

SEQ ID NO: 2705 - DNA, 18 bp, Artificial Sequence
  Description of Artificial Sequence: Synthetic primer
tgtgggaagttcagtggc

SEQ ID NO: 2706 - DNA, 27 bp, Artificial Sequence
  Description of Artificial Sequence: Synthetic primer
aattcctttattttcacatatactaaa

SEQ ID NO: 2707 - DNA, 19 bp, Artificial Sequence
  Description of Artificial Sequence: Synthetic primer
actgtggtttgcaccctaa

SEQ ID NO: 2708 - DNA, 19 bp, Artificial Sequence
  Description of Artificial Sequence: Synthetic primer
ccaactgctgtatttaaca

SEQ ID NO: 2709 - DNA, 18 bp, Artificial Sequence
  Description of Artificial Sequence: Synthetic primer
cagtactgcagagaaaga

SEQ ID NO: 2710 - DNA, 26 bp, Artificial Sequence
  Description of Artificial Sequence: Synthetic primer
accatgctgctcaaatcttcacagag

SEQ ID NO: 2711 - DNA, 18 bp, Artificial Sequence
  Description of Artificial Sequence: Synthetic primer
agtttggagattacaggt

SEQ ID NO: 2712 - DNA, 22 bp, Artificial Sequence
  Description of Artificial Sequence: Synthetic primer
agtggtattttggtttttaatc

SEQ ID NO: 2713 - DNA, 20 bp, Artificial Sequence
  Description of Artificial Sequence: Synthetic primer
ccaaaatagttagacccttg

SEQ ID NO: 2714 - DNA, 17 bp, Artificial Sequence
  Description of Artificial Sequence: Synthetic primer
tgggatgccttttactt

SEQ ID NO: 2715 - DNA, 25 bp, Artificial Sequence
  Description of Artificial Sequence: Synthetic primer
agaaaagcatcatagttctgaaatg

SEQ ID NO: 2716 - DNA, 19 bp, Artificial Sequence
  Description of Artificial Sequence: Synthetic primer
cctctcatttgtggcttag

SEQ ID NO: 2717 - DNA, 18 bp, Artificial Sequence
  Description of Artificial Sequence: Synthetic primer
tgtccaaaaacatccttc

SEQ ID NO: 2718 - DNA, 20 bp, Artificial Sequence
  Description of Artificial Sequence: Synthetic primer
catgcatcagagtagaaaga

SEQ ID NO: 2719 - DNA, 26 bp, Artificial Sequence
  Description of Artificial Sequence: Synthetic primer
gttatctattccatttgacatagtag

SEQ ID NO: 2720 - DNA, 19 bp, Artificial Sequence
  Description of Artificial Sequence: Synthetic primer
gtggggtactgtaacatat

SEQ ID NO: 2721 - DNA, 23 bp, Artificial Sequence
  Description of Artificial Sequence: Synthetic primer
aagtgtactatttgtgtgataaa

SEQ ID NO: 2722 - DNA, 26 bp, Artificial Sequence
  Description of Artificial Sequence: Synthetic primer
acatgacagtttcttatatttggact

SEQ ID NO: 2723 - DNA, 17 bp, Artificial Sequence
  Description of Artificial Sequence: Synthetic primer
tgcttccatgtgcaatc

SEQ ID NO: 2724 - DNA, 22 bp, Artificial Sequence
  Description of Artificial Sequence: Synthetic primer
ttactctgtgaaatagaggaat

SEQ ID NO: 2725 - DNA, 22 bp, Artificial Sequence
  Description of Artificial Sequence: Synthetic primer
tcacagagtaagattatggaag

SEQ ID NO: 2726 - DNA, 23 bp, Artificial Sequence
  Description of Artificial Sequence: Synthetic primer
tgagtgcatgttttaaacctcta

SEQ ID NO: 2727 - DNA, 17 bp, Artificial Sequence
  Description of Artificial Sequence: Synthetic primer
caccagggtcaagagaa

SEQ ID NO: 2728 - DNA, 26 bp, Artificial Sequence
  Description of Artificial Sequence: Synthetic primer
ctccaggtcagcagcctccagagggg

SEQ ID NO: 2729 - DNA, 17 bp, Artificial Sequence
  Description of Artificial Sequence: Synthetic primer
aaggagagctggcaaga

SEQ ID NO: 2730 - DNA, 20 bp, Artificial Sequence
  Description of Artificial Sequence: Synthetic primer
ctccttcctctttctccaga

SEQ ID NO: 2731 - DNA, 18 bp, Artificial Sequence
  Description of Artificial Sequence: Synthetic primer
actgagcagttgctcaag

SEQ ID NO: 2732 - DNA, 22 bp, Artificial Sequence
  Description of Artificial Sequence: Synthetic primer
atttgaaatcattcaggacttt

SEQ ID NO: 2733 - DNA, 25 bp, Artificial Sequence
  Description of Artificial Sequence: Synthetic primer
ttagtctttcttgctgggaatcaaa

SEQ ID NO: 2734 - DNA, 17 bp, Artificial Sequence
  Description of Artificial Sequence: Synthetic primer
tccccacatgcatcctt

SEQ ID NO: 2735 - DNA, 23 bp, Artificial Sequence
  Description of Artificial Sequence: Synthetic primer
ggtcattgaaacagacattttaa

SEQ ID NO: 2736 - DNA, 20 bp, Artificial Sequence
  Description of Artificial Sequence: Synthetic primer
ctgtttcaatgacctgtatt

SEQ ID NO: 2737 - DNA, 22 bp, Artificial Sequence
  Description of Artificial Sequence: Synthetic primer
tgcaggttcagggcaaggtgtg

SEQ ID NO: 2738 - DNA, 17 bp, Artificial Sequence
  Description of Artificial Sequence: Synthetic primer
ggtgactgacagaggga

SEQ ID NO: 2739 - DNA, 18 bp, Artificial Sequence
  Description of Artificial Sequence: Synthetic primer
aagaattggggttaggtc

SEQ ID NO: 2740 - DNA, 20 bp, Artificial Sequence
  Description of Artificial Sequence: Synthetic primer
gacacagtctccagcagaat

SEQ ID NO: 2741 - DNA, 21 bp, Artificial Sequence
  Description of Artificial Sequence: Synthetic primer
ggagactgtgtcttaaaactt

SEQ ID NO: 2742 - DNA, 17 bp, Artificial Sequence
  Description of Artificial Sequence: Synthetic primer
caagcaaggcagagaaa

SEQ ID NO: 2743 - DNA, 19 bp, Artificial Sequence
  Description of Artificial Sequence: Synthetic primer
gagtaggtggtgggatctc

SEQ ID NO: 2744 - DNA, 24 bp, Artificial Sequence
  Description of Artificial Sequence: Synthetic primer
cactgttctattacagtgttcttc

SEQ ID NO: 2745 - DNA, 17 bp, Artificial Sequence
  Description of Artificial Sequence: Synthetic primer
cccaaaccatggttctt

SEQ ID NO: 2746 - DNA, 20 bp, Artificial Sequence
  Description of Artificial Sequence: Synthetic primer
cacttctcacttatcatctg

SEQ ID NO: 2747 - DNA, 26 bp, Artificial Sequence
  Description of Artificial Sequence: Synthetic primer
cttatgttttcccatatctagatgtc

SEQ ID NO: 2748 - DNA, 23 bp, Artificial Sequence
  Description of Artificial Sequence: Synthetic primer
agatatgggaaaacataagaaaa

SEQ ID NO: 2749 - DNA, 25 bp, Artificial Sequence
  Description of Artificial Sequence: Synthetic primer
ttaacatgttttctctcactgtact

SEQ ID NO: 2750 - DNA, 23 bp, Artificial Sequence
  Description of Artificial Sequence: Synthetic primer
aactattggcaattctgtaattc

SEQ ID NO: 2751 - DNA, 20 bp, Artificial Sequence
  Description of Artificial Sequence: Synthetic primer
tactctacagtgcttgttta

SEQ ID NO: 2752 - DNA, 18 bp, Artificial Sequence
  Description of Artificial Sequence: Synthetic primer
cccttttagggtctactc

SEQ ID NO: 2753 - DNA, 24 bp, Artificial Sequence
  Description of Artificial Sequence: Synthetic primer
attcagttcttcattctcttcatc

SEQ ID NO: 2754 - DNA, 24 bp, Artificial Sequence
  Description of Artificial Sequence: Synthetic primer
aaacaaagacaggttcaaaaatac

SEQ ID NO: 2755 - DNA, 18 bp, Artificial Sequence
  Description of Artificial Sequence: Synthetic primer
ggatgtttctggaacaat

SEQ ID NO: 2756 - DNA, 19 bp, Artificial Sequence
  Description of Artificial Sequence: Synthetic primer
acatctcaacagagttaca

SEQ ID NO: 2757 - DNA, 17 bp, Artificial Sequence
  Description of Artificial Sequence: Synthetic primer
gcattcccagactcaga

SEQ ID NO: 2758 - DNA, 26 bp, Artificial Sequence
  Description of Artificial Sequence: Synthetic primer
tctggactttattttgctaaccataa

SEQ ID NO: 2759 - DNA, 17 bp, Artificial Sequence
  Description of Artificial Sequence: Synthetic primer
gagtatggctgggaatt

SEQ ID NO: 2760 - DNA, 24 bp, Artificial Sequence
  Description of Artificial Sequence: Synthetic primer
atggtggttgtgaaagtgatttag

SEQ ID NO: 2761 - DNA, 21 bp, Artificial Sequence
  Description of Artificial Sequence: Synthetic primer
caccatcaagcttacaacatc

SEQ ID NO: 2762 - DNA, 20 bp, Artificial Sequence
  Description of Artificial Sequence: Synthetic primer
ccttccctttagtagtagag

SEQ ID NO: 2763 - DNA, 23 bp, Artificial Sequence
  Description of Artificial Sequence: Synthetic primer
accaataaacagcctcctataaa

SEQ ID NO: 2764 - DNA, 23 bp, Artificial Sequence
  Description of Artificial Sequence: Synthetic primer
atgccaacgtcctttccatgcac

SEQ ID NO: 2765 - DNA, 20 bp, Artificial Sequence
  Description of Artificial Sequence: Synthetic primer
aaatgtgtaaatggcactgt

SEQ ID NO: 2766 - DNA, 19 bp, Artificial Sequence
  Description of Artificial Sequence: Synthetic primer
ccagtcatctctggtgtca

SEQ ID NO: 2767 - DNA, 22 bp, Artificial Sequence
  Description of Artificial Sequence: Synthetic primer
tggccctgggaaggggaaataa

SEQ ID NO: 2768 - DNA, 24 bp, Artificial Sequence
  Description of Artificial Sequence: Synthetic primer
tgagaaaaagaataagaacaaaaa

SEQ ID NO: 2769 - DNA, 21 bp, Artificial Sequence
  Description of Artificial Sequence: Synthetic primer
actaatacagagtgtgttcgc

SEQ ID NO: 2770 - DNA, 25 bp, Artificial Sequence
  Description of Artificial Sequence: Synthetic primer
cctcctaatttaaaatactgtattc

SEQ ID NO: 2771 - DNA, 22 bp, Artificial Sequence
  Description of Artificial Sequence: Synthetic primer
ttggacggtcaaaaggagaatg

SEQ ID NO: 2772 - DNA, 17 bp, Artificial Sequence
  Description of Artificial Sequence: Synthetic primer
gggtgccaaacacctac

SEQ ID NO: 2773 - DNA, 25 bp, Artificial Sequence
  Description of Artificial Sequence: Synthetic primer
tattgctttgcactttggtttgata

SEQ ID NO: 2774 - DNA, 23 bp, Artificial Sequence
  Description of Artificial Sequence: Synthetic primer
gaatctgttttacagaagtaaat

SEQ ID NO: 2775 - DNA, 26 bp, Artificial Sequence
  Description of Artificial Sequence: Synthetic primer
catttgaaacattagattttttcact

SEQ ID NO: 2776 - DNA, 18 bp, Artificial Sequence
  Description of Artificial Sequence: Synthetic primer
tttctcacctctgattcc

SEQ ID NO: 2777 - DNA, 23 bp, Artificial Sequence
  Description of Artificial Sequence: Synthetic primer
gaatcagaggtgagaaatgtcgg

SEQ ID NO: 2778 - DNA, 27 bp, Artificial Sequence
  Description of Artificial Sequence: Synthetic primer
tgcctcccagtgcccagaatgagaccc

SEQ ID NO: 2779 - DNA, 17 bp, Artificial Sequence
  Description of Artificial Sequence: Synthetic primer
aggtcaccatcagtcca

SEQ ID NO: 2780 - DNA, 17 bp, Artificial Sequence
  Description of Artificial Sequence: Synthetic primer
tccataggggatcagtg

SEQ ID NO: 2781 - DNA, 17 bp, Artificial Sequence
  Description of Artificial Sequence: Synthetic primer
ggcttcaggtaagagtt

SEQ ID NO: 2782 - DNA, 19 bp, Artificial Sequence
  Description of Artificial Sequence: Synthetic primer
tctccttgctcagaactct

SEQ ID NO: 2783 - DNA, 23 bp, Artificial Sequence
  Description of Artificial Sequence: Synthetic primer
ttcttggtaaccaaaatcacatc

SEQ ID NO: 2784 - DNA, 22 bp, Artificial Sequence
  Description of Artificial Sequence: Synthetic primer
tcgcccactgttcctgtccacc

SEQ ID NO: 2785 - DNA, 22 bp, Artificial Sequence
  Description of Artificial Sequence: Synthetic primer
acgactacaccgcgcagaatga

SEQ ID NO: 2786 - DNA, 18 bp, Artificial Sequence
  Description of Artificial Sequence: Synthetic primer
aagggccagatcatcaac

SEQ ID NO: 2787 - DNA, 17 bp, Artificial Sequence
  Description of Artificial Sequence: Synthetic primer
tctcctttccaccagtc

SEQ ID NO: 2788 - DNA, 18 bp, Artificial Sequence
  Description of Artificial Sequence: Synthetic primer
gggtctctttgaggactt

SEQ ID NO: 2789 - DNA, 19 bp, Artificial Sequence
  Description of Artificial Sequence: Synthetic primer
taccttagttgcatgtgat

SEQ ID NO: 2790 - DNA, 26 bp, Artificial Sequence
  Description of Artificial Sequence: Synthetic primer
agagataggagcaaaaattacaaaaa

SEQ ID NO: 2791 - DNA, 17 bp, Artificial Sequence
  Description of Artificial Sequence: Synthetic primer
cttgggcaaagttgaca

SEQ ID NO: 2792 - DNA, 18 bp, Artificial Sequence
  Description of Artificial Sequence: Synthetic primer
atgggaagcagctcctta

SEQ ID NO: 2793 - DNA, 20 bp, Artificial Sequence
  Description of Artificial Sequence: Synthetic primer
ctcaacatgacaccaacaca

SEQ ID NO: 2794 - DNA, 20 bp, Artificial Sequence
  Description of Artificial Sequence: Synthetic primer
taatggcatttgctgtggtt

SEQ ID NO: 2795 - DNA, 27 bp, Artificial Sequence
  Description of Artificial Sequence: Synthetic primer
aagagttatttatttttccttaatctc

SEQ ID NO: 2796 - DNA, 27 bp, Artificial Sequence
  Description of Artificial Sequence: Synthetic primer
aaaaaagccatattaacatttttttcc

SEQ ID NO: 2797 - DNA, 26 bp, Artificial Sequence
  Description of Artificial Sequence: Synthetic primer
ggtggattttcctccaagtgattaaa

SEQ ID NO: 2798 - DNA, 23 bp, Artificial Sequence
  Description of Artificial Sequence: Synthetic primer
tagttagggtttcttgatcttgg

SEQ ID NO: 2799 - DNA, 20 bp, Artificial Sequence
  Description of Artificial Sequence: Synthetic primer
caagggtgtttggtaaggtc

SEQ ID NO: 2800 - DNA, 24 bp, Artificial Sequence
  Description of Artificial Sequence: Synthetic primer
attggaataatggatcaaaaatag

SEQ ID NO: 2801 - DNA, 23 bp, Artificial Sequence
  Description of Artificial Sequence: Synthetic primer
ttggctaatttccaaattattgc

SEQ ID NO: 2802 - DNA, 25 bp, Artificial Sequence
  Description of Artificial Sequence: Synthetic primer
gagaaaatttcataaagccattctc

SEQ ID NO: 2803 - DNA, 22 bp, Artificial Sequence
  Description of Artificial Sequence: Synthetic primer
tcaagctctgaaattcataatc

SEQ ID NO: 2804 - DNA, 23 bp, Artificial Sequence
  Description of Artificial Sequence: Synthetic primer
ggttaatttttaggaagatcttg

SEQ ID NO: 2805 - DNA, 25 bp, Artificial Sequence
  Description of Artificial Sequence: Synthetic primer
agtctcagtattattagaacataaa

SEQ ID NO: 2806 - DNA, 26 bp, Artificial Sequence
  Description of Artificial Sequence: Synthetic primer
cttacaaaaattgctattaaactcct

SEQ ID NO: 2807 - DNA, 24 bp, Artificial Sequence
  Description of Artificial Sequence: Synthetic primer
ttccatctctaagtcaaattggtc

SEQ ID NO: 2808 - DNA, 23 bp, Artificial Sequence
  Description of Artificial Sequence: Synthetic primer
aaactcaaccaagctgtgataag

SEQ ID NO: 2809 - DNA, 24 bp, Artificial Sequence
  Description of Artificial Sequence: Synthetic primer
gtcataaaccagcaataaacaata

SEQ ID NO: 2810 - DNA, 25 bp, Artificial Sequence
  Description of Artificial Sequence: Synthetic primer
gaacttttcacttatctcatgttag

SEQ ID NO: 2811 - DNA, 19 bp, Artificial Sequence
  Description of Artificial Sequence: Synthetic primer
gaaaaaacaccaataccca

SEQ ID NO: 2812 - DNA, 24 bp, Artificial Sequence
  Description of Artificial Sequence: Synthetic primer
aaatacatggtaataacttttctt

SEQ ID NO: 2813 - DNA, 21 bp, Artificial Sequence
  Description of Artificial Sequence: Synthetic primer
tccaaaccagaaactatttag

SEQ ID NO: 2814 - DNA, 20 bp, Artificial Sequence
  Description of Artificial Sequence: Synthetic primer
gtggtggaaaacaattttac

SEQ ID NO: 2815 - DNA, 23 bp, Artificial Sequence
  Description of Artificial Sequence: Synthetic primer
taatgccacatggtaattgctgc

SEQ ID NO: 2816 - DNA, 17 bp, Artificial Sequence
  Description of Artificial Sequence: Synthetic primer
agaggagcttgaggatg

SEQ ID NO: 2817 - DNA, 18 bp, Artificial Sequence
  Description of Artificial Sequence: Synthetic primer
agaggagcttgaggatga

SEQ ID NO: 2818 - DNA, 17 bp, Artificial Sequence
  Description of Artificial Sequence: Synthetic primer
aggctgaatggggaaaa

SEQ ID NO: 2819 - DNA, 17 bp, Artificial Sequence
  Description of Artificial Sequence: Synthetic primer
atacctccatctgcacc

SEQ ID NO: 2820 - DNA, 20 bp, Artificial Sequence
  Description of Artificial Sequence: Synthetic primer
gcagatggaggtatctctta

SEQ ID NO: 2821 - DNA, 27 bp, Artificial Sequence
  Description of Artificial Sequence: Synthetic primer
ctcccacccacatttttctcagcaatt

SEQ ID NO: 2822 - DNA, 27 bp, Artificial Sequence
  Description of Artificial Sequence: Synthetic primer
gattcaaatcctcctcttcagcaaaag

SEQ ID NO: 2823 - DNA, 17 bp, Artificial Sequence
  Description of Artificial Sequence: Synthetic primer
gggctgcaaaccaccaa

SEQ ID NO: 2824 - DNA, 25 bp, Artificial Sequence
  Description of Artificial Sequence: Synthetic primer
gatacctactgaattattgaggata

SEQ ID NO: 2825 - DNA, 25 bp, Artificial Sequence
  Description of Artificial Sequence: Synthetic primer
ttaccatttgtggtttatttgctct

SEQ ID NO: 2826 - DNA, 25 bp, Artificial Sequence
  Description of Artificial Sequence: Synthetic primer
actggaaactgttgaaagttaaaaa

SEQ ID NO: 2827 - DNA, 17 bp, Artificial Sequence
  Description of Artificial Sequence: Synthetic primer
ttgtccctggtacacat

SEQ ID NO: 2828 - DNA, 22 bp, Artificial Sequence
  Description of Artificial Sequence: Synthetic primer
atgaaagtatccttccaaaata

SEQ ID NO: 2829 - DNA, 20 bp, Artificial Sequence
  Description of Artificial Sequence: Synthetic primer
aattattgtcaagcctttct

SEQ ID NO: 2830 - DNA, 26 bp, Artificial Sequence
  Description of Artificial Sequence: Synthetic primer
gtaaactctaggatatccaaaggtgt

SEQ ID NO: 2831 - DNA, 24 bp, Artificial Sequence
  Description of Artificial Sequence: Synthetic primer
gaatatgcagtgtctgagaaactt

SEQ ID NO: 2832 - DNA, 26 bp, Artificial Sequence
  Description of Artificial Sequence: Synthetic primer
cagctgtctgactccaaaccctttat

SEQ ID NO: 2833 - DNA, 17 bp, Artificial Sequence
  Description of Artificial Sequence: Synthetic primer
agaaacactcccaaagc

SEQ ID NO: 2834 - DNA, 22 bp, Artificial Sequence
  Description of Artificial Sequence: Synthetic primer
tgactgatttttaacctatcat

SEQ ID NO: 2835 - DNA, 25 bp, Artificial Sequence
  Description of Artificial Sequence: Synthetic primer
taaccagagagcttcctggcccaca

SEQ ID NO: 2836 - DNA, 26 bp, Artificial Sequence
  Description of Artificial Sequence: Synthetic primer
ttcccagggcccaaagcaagaaaatg

SEQ ID NO: 2837 - DNA, 17 bp, Artificial Sequence
  Description of Artificial Sequence: Synthetic primer
aggctttggacaggctc

SEQ ID NO: 2838 - DNA, 23 bp, Artificial Sequence
  Description of Artificial Sequence: Synthetic primer
aatttctctttgcacctgaacaa

SEQ ID NO: 2839 - DNA, 19 bp, Artificial Sequence
  Description of Artificial Sequence: Synthetic primer
aggagaaggagaatttggg

SEQ ID NO: 2840 - DNA, 17 bp, Artificial Sequence
  Description of Artificial Sequence: Synthetic primer
aacatggactggagtgg

SEQ ID NO: 2841 - DNA, 19 bp, Artificial Sequence
  Description of Artificial Sequence: Synthetic primer
gagttttccaaatccacat

SEQ ID NO: 2842 - DNA, 20 bp, Artificial Sequence
  Description of Artificial Sequence: Synthetic primer
tctgttgatttcaaaacaca

SEQ ID NO: 2843 - DNA, 24 bp, Artificial Sequence
  Description of Artificial Sequence: Synthetic primer
catatacttaatccttttgcctca

SEQ ID NO: 2844 - DNA, 26 bp, Artificial Sequence
  Description of Artificial Sequence: Synthetic primer
gagaattaaaatgaactgaggatttc

SEQ ID NO: 2845 - DNA, 24 bp, Artificial Sequence
  Description of Artificial Sequence: Synthetic primer
attacattggctaacttcagaaaa

SEQ ID NO: 2846 - DNA, 20 bp, Artificial Sequence
  Description of Artificial Sequence: Synthetic primer
cttctgcctcaattactttc

SEQ ID NO: 2847 - DNA, 23 bp, Artificial Sequence
  Description of Artificial Sequence: Synthetic primer
gaggcttataaaatgattaaagg

SEQ ID NO: 2848 - DNA, 21 bp, Artificial Sequence
  Description of Artificial Sequence: Synthetic primer
cccttttcaattctgtctgag

SEQ ID NO: 2849 - DNA, 25 bp, Artificial Sequence
  Description of Artificial Sequence: Synthetic primer
aagtatacaatcaggcagaaaaagg

SEQ ID NO: 2850 - DNA, 17 bp, Artificial Sequence
  Description of Artificial Sequence: Synthetic primer
tgactttacaggcactt

SEQ ID NO: 2851 - DNA, 20 bp, Artificial Sequence
  Description of Artificial Sequence: Synthetic primer
cccatggtttcacagcaaag

SEQ ID NO: 2852 - DNA, 21 bp, Artificial Sequence
  Description of Artificial Sequence: Synthetic primer
tttgaagatgtggaaagtaat

SEQ ID NO: 2853 - DNA, 17 bp, Artificial Sequence
  Description of Artificial Sequence: Synthetic primer
agcaggctgaatcctct

SEQ ID NO: 2854 - DNA, 18 bp, Artificial Sequence
  Description of Artificial Sequence: Synthetic primer
tgacaccttaaagcagaa

SEQ ID NO: 2855 - DNA, 21 bp, Artificial Sequence
  Description of Artificial Sequence: Synthetic primer
gcagggtataacaaagctaaa

SEQ ID NO: 2856 - DNA, 26 bp, Artificial Sequence
  Description of Artificial Sequence: Synthetic primer
tgatctcttaagatgcatctgaaaaa

SEQ ID NO: 2857 - DNA, 21 bp, Artificial Sequence
  Description of Artificial Sequence: Synthetic primer
atcagaatagtcaaacagtag

SEQ ID NO: 2858 - DNA, 20 bp, Artificial Sequence
  Description of Artificial Sequence: Synthetic primer
gcacaaaggttacagctagt

SEQ ID NO: 2859 - DNA, 20 bp, Artificial Sequence
  Description of Artificial Sequence: Synthetic primer
tccaacagtggaaataaaat

SEQ ID NO: 2860 - DNA, 20 bp, Artificial Sequence
  Description of Artificial Sequence: Synthetic primer
gcagaaaacttcaacaaagg

SEQ ID NO: 2861 - DNA, 26 bp, Artificial Sequence
  Description of Artificial Sequence: Synthetic primer
gtgcttaggaagtggataaaagtcaa

SEQ ID NO: 2862 - DNA, 20 bp, Artificial Sequence
  Description of Artificial Sequence: Synthetic primer
aggagaaaaggagtcactag

SEQ ID NO: 2863 - DNA, 17 bp, Artificial Sequence
  Description of Artificial Sequence: Synthetic primer
ttttctcttccccatcc

SEQ ID NO: 2864 - DNA, 26 bp, Artificial Sequence
  Description of Artificial Sequence: Synthetic primer
gaagaaaaaacctggacagccagata

SEQ ID NO: 2865 - DNA, 17 bp, Artificial Sequence
  Description of Artificial Sequence: Synthetic primer
aggtgcttacaggtgaa

SEQ ID NO: 2866 - DNA, 18 bp, Artificial Sequence
  Description of Artificial Sequence: Synthetic primer
gcctgagtctctctaatt

SEQ ID NO: 2867 - DNA, 18 bp, Artificial Sequence
  Description of Artificial Sequence: Synthetic primer
agaagagcatagctagac

SEQ ID NO: 2868 - DNA, 24 bp, Artificial Sequence
  Description of Artificial Sequence: Synthetic primer
ctagctatgctcttctccagcctc

SEQ ID NO: 2869 - DNA, 20 bp, Artificial Sequence
  Description of Artificial Sequence: Synthetic primer
aaacagcatgactcagatag

SEQ ID NO: 2870 - DNA, 17 bp, Artificial Sequence
  Description of Artificial Sequence: Synthetic primer
gaggttgaaggagaggc

SEQ ID NO: 2871 - DNA, 22 bp, Artificial Sequence
  Description of Artificial Sequence: Synthetic primer
ctcatccataaacaccaacact

SEQ ID NO: 2872 - DNA, 17 bp, Artificial Sequence
  Description of Artificial Sequence: Synthetic primer
cctcattgaaacagccc

SEQ ID NO: 2873 - DNA, 26 bp, Artificial Sequence
  Description of Artificial Sequence: Synthetic primer
ggaggatgtctgtgtctaaaattggt

SEQ ID NO: 2874 - DNA, 26 bp, Artificial Sequence
  Description of Artificial Sequence: Synthetic primer
ggaaatcatcgatgaaaaagcatgtt

SEQ ID NO: 2875 - DNA, 19 bp, Artificial Sequence
  Description of Artificial Sequence: Synthetic primer
ccaaaagcctatcatcaca

SEQ ID NO: 2876 - DNA, 23 bp, Artificial Sequence
  Description of Artificial Sequence: Synthetic primer
gggagagggtaaaaagaggttaa

SEQ ID NO: 2877 - DNA, 17 bp, Artificial Sequence
  Description of Artificial Sequence: Synthetic primer
ccaactcctagaagcca

SEQ ID NO: 2878 - DNA, 23 bp, Artificial Sequence
  Description of Artificial Sequence: Synthetic primer
gatgtgtaaaataactgagaaaa

SEQ ID NO: 2879 - DNA, 17 bp, Artificial Sequence
  Description of Artificial Sequence: Synthetic primer
cagctaagtcactctga

SEQ ID NO: 2880 - DNA, 24 bp, Artificial Sequence
  Description of Artificial Sequence: Synthetic primer
gcagcgaaggggcctcacggggac

SEQ ID NO: 2881 - DNA, 19 bp, Artificial Sequence
  Description of Artificial Sequence: Synthetic primer
cgcaggaacatcatgaaaa

SEQ ID NO: 2882 - DNA, 21 bp, Artificial Sequence
  Description of Artificial Sequence: Synthetic primer
ggataagaaccaggaaaacat

SEQ ID NO: 2883 - DNA, 26 bp, Artificial Sequence
  Description of Artificial Sequence: Synthetic primer
gaaagttcttgtattaaaagaagtgg

SEQ ID NO: 2884 - DNA, 22 bp, Artificial Sequence
  Description of Artificial Sequence: Synthetic primer
tcagtaccactatctcaatctt

SEQ ID NO: 2885 - DNA, 18 bp, Artificial Sequence
  Description of Artificial Sequence: Synthetic primer
cagtactggagaatgtct

SEQ ID NO: 2886 - DNA, 17 bp, Artificial Sequence
  Description of Artificial Sequence: Synthetic primer
gggaggcttagggagaa

SEQ ID NO: 2887 - DNA, 21 bp, Artificial Sequence
  Description of Artificial Sequence: Synthetic primer
aaactgtggggacttacgtgt

SEQ ID NO: 2888 - DNA, 17 bp, Artificial Sequence
  Description of Artificial Sequence: Synthetic primer
cagctccttggtgtaga

SEQ ID NO: 2889 - DNA, 26 bp, Artificial Sequence
  Description of Artificial Sequence: Synthetic primer
caaacagagaaaattaaaatcaaaca

SEQ ID NO: 2890 - DNA, 23 bp, Artificial Sequence
  Description of Artificial Sequence: Synthetic primer
tcctgagctgattggggttctgg

SEQ ID NO: 2891 - DNA, 17 bp, Artificial Sequence
  Description of Artificial Sequence: Synthetic primer
aagctcaggaggacaaa

SEQ ID NO: 2892 - DNA, 17 bp, Artificial Sequence
  Description of Artificial Sequence: Synthetic primer
ggagaagggcctaggtg

SEQ ID NO: 2893 - DNA, 25 bp, Artificial Sequence
  Description of Artificial Sequence: Synthetic primer
aggacatggggctggttttggtaaa

SEQ ID NO: 2894 - DNA, 19 bp, Artificial Sequence
  Description of Artificial Sequence: Synthetic primer
ttctaggaaggcaacaact

SEQ ID NO: 2895 - DNA, 19 bp, Artificial Sequence
  Description of Artificial Sequence: Synthetic primer
ggaataacctgcagcacca

SEQ ID NO: 2896 - DNA, 22 bp, Artificial Sequence
  Description of Artificial Sequence: Synthetic primer
aaaagcacaaaagtagattcct

SEQ ID NO: 2897 - DNA, 26 bp, Artificial Sequence
  Description of Artificial Sequence: Synthetic primer
tgcttttacacattgaactgacaggt

SEQ ID NO: 2898 - DNA, 19 bp, Artificial Sequence
  Description of Artificial Sequence: Synthetic primer
caggggccagtggagaggt

SEQ ID NO: 2899 - DNA, 20 bp, Artificial Sequence
  Description of Artificial Sequence: Synthetic primer
tttattcgtgctcaagttat

SEQ ID NO: 2900 - DNA, 17 bp, Artificial Sequence
  Description of Artificial Sequence: Synthetic primer
cgaataaaggcagctca

SEQ ID NO: 2901 - DNA, 25 bp, Artificial Sequence
  Description of Artificial Sequence: Synthetic primer
agcaaaaacattaattctctgcctg

SEQ ID NO: 2902 - DNA, 24 bp, Artificial Sequence
  Description of Artificial Sequence: Synthetic primer
cttcctttcagcctccagtttttg

SEQ ID NO: 2903 - DNA, 17 bp, Artificial Sequence
  Description of Artificial Sequence: Synthetic primer
gctagagccattattgc

SEQ ID NO: 2904 - DNA, 17 bp, Artificial Sequence
  Description of Artificial Sequence: Synthetic primer
aagtccaggctgtacac

SEQ ID NO: 2905 - DNA, 17 bp, Artificial Sequence
  Description of Artificial Sequence: Synthetic primer
accaagagtcagacaca

SEQ ID NO: 2906 - DNA, 19 bp, Artificial Sequence
  Description of Artificial Sequence: Synthetic primer
agaacccaagaccccagca

SEQ ID NO: 2907 - DNA, 20 bp, Artificial Sequence
  Description of Artificial Sequence: Synthetic primer
tggggcctgtctggcctgag

SEQ ID NO: 2908 - DNA, 17 bp, Artificial Sequence
  Description of Artificial Sequence: Synthetic primer
atggagggactcctttt

SEQ ID NO: 2909 - DNA, 22 bp, Artificial Sequence
  Description of Artificial Sequence: Synthetic primer
aggcaggaacgtggttttagac

SEQ ID NO: 2910 - DNA, 24 bp, Artificial Sequence
  Description of Artificial Sequence: Synthetic primer
ggactgaataacttagttacataa

SEQ ID NO: 2911 - DNA, 24 bp, Artificial Sequence
  Description of Artificial Sequence: Synthetic primer
accatttccttataaaacctgatt

SEQ ID NO: 2912 - DNA, 19 bp, Artificial Sequence
  Description of Artificial Sequence: Synthetic primer
gatgaaaggatttgagtgc

SEQ ID NO: 2913 - DNA, 27 bp, Artificial Sequence
  Description of Artificial Sequence: Synthetic primer
caccaatacctatccaaaaaagaaatt

SEQ ID NO: 2914 - DNA, 24 bp, Artificial Sequence
  Description of Artificial Sequence: Synthetic primer
tgactgatatgatttcagggggac

SEQ ID NO: 2915 - DNA, 19 bp, Artificial Sequence
  Description of Artificial Sequence: Synthetic primer
gaggcagaggaaaagaaaa

SEQ ID NO: 2916 - DNA, 20 bp, Artificial Sequence
  Description of Artificial Sequence: Synthetic primer
acacttataagcctcatgat

SEQ ID NO: 2917 - DNA, 26 bp, Artificial Sequence
  Description of Artificial Sequence: Synthetic primer
ttccatgagaccttaaaagataacct

SEQ ID NO: 2918 - DNA, 23 bp, Artificial Sequence
  Description of Artificial Sequence: Synthetic primer
tgatctaaatcccttttgatatg

SEQ ID NO: 2919 - DNA, 21 bp, Artificial Sequence
  Description of Artificial Sequence: Synthetic primer
tgttgagtaggctttccttag

SEQ ID NO: 2920 - DNA, 17 bp, Artificial Sequence
  Description of Artificial Sequence: Synthetic primer
gagaaaagcggtcttgc

SEQ ID NO: 2921 - DNA, 20 bp, Artificial Sequence
  Description of Artificial Sequence: Synthetic primer
agtccagttaaaaaccatga

SEQ ID NO: 2922 - DNA, 22 bp, Artificial Sequence
  Description of Artificial Sequence: Synthetic primer
aagtatacagtgtgaaggggaa

SEQ ID NO: 2923 - DNA, 26 bp, Artificial Sequence
  Description of Artificial Sequence: Synthetic primer
tcccaaatgttaaccattttattaaa

SEQ ID NO: 2924 - DNA, 19 bp, Artificial Sequence
  Description of Artificial Sequence: Synthetic primer
aaatggttaacatttggga

SEQ ID NO: 2925 - DNA, 21 bp, Artificial Sequence
  Description of Artificial Sequence: Synthetic primer
ccactcccttagtttcatcat

SEQ ID NO: 2926 - DNA, 24 bp, Artificial Sequence
  Description of Artificial Sequence: Synthetic primer
ggaaagtatgaaaggagatagaag

SEQ ID NO: 2927 - DNA, 20 bp, Artificial Sequence
  Description of Artificial Sequence: Synthetic primer
actaagcagcacaatttcta

SEQ ID NO: 2928 - DNA, 24 bp, Artificial Sequence
  Description of Artificial Sequence: Synthetic primer
agtgaatttgttaagtgcaaatgg

SEQ ID NO: 2929 - DNA, 18 bp, Artificial Sequence
  Description of Artificial Sequence: Synthetic primer
ttgttatggaattggcct

SEQ ID NO: 2930 - DNA, 21 bp, Artificial Sequence
  Description of Artificial Sequence: Synthetic primer
atttagtggtaggcagtgggg

SEQ ID NO: 2931 - DNA, 23 bp, Artificial Sequence
  Description of Artificial Sequence: Synthetic primer
tggctaacatacatcttaaattc

SEQ ID NO: 2932 - DNA, 24 bp, Artificial Sequence
  Description of Artificial Sequence: Synthetic primer
actgccaacataatattaaactat

SEQ ID NO: 2933 - DNA, 18 bp, Artificial Sequence
  Description of Artificial Sequence: Synthetic primer
ctgcaactggattgtagg

SEQ ID NO: 2934 - DNA, 25 bp, Artificial Sequence
  Description of Artificial Sequence: Synthetic primer
cactttttacactgtaattaaagat

SEQ ID NO: 2935 - DNA, 17 bp, Artificial Sequence
  Description of Artificial Sequence: Synthetic primer
tgaacagggtgcttaac

SEQ ID NO: 2936 - DNA, 25 bp, Artificial Sequence
  Description of Artificial Sequence: Synthetic primer
ttgtttattgatgaattcatacaca

SEQ ID NO: 2937 - DNA, 26 bp, Artificial Sequence
  Description of Artificial Sequence: Synthetic primer
atcttgaatttcttcacttaaaaaaa

SEQ ID NO: 2938 - DNA, 21 bp, Artificial Sequence
  Description of Artificial Sequence: Synthetic primer
ggcagggactgaatttgaacc

SEQ ID NO: 2939 - DNA, 19 bp, Artificial Sequence
  Description of Artificial Sequence: Synthetic primer
taaatagcctatcctccac

SEQ ID NO: 2940 - DNA, 21 bp, Artificial Sequence
  Description of Artificial Sequence: Synthetic primer
tcttcattgctttcacttttc

SEQ ID NO: 2941 - DNA, 21 bp, Artificial Sequence
  Description of Artificial Sequence: Synthetic primer
gaaaagtgaaagcaatgaaga

SEQ ID NO: 2942 - DNA, 24 bp, Artificial Sequence
  Description of Artificial Sequence: Synthetic primer
tattgaaggctaaagctgataata

SEQ ID NO: 2943 - DNA, 25 bp, Artificial Sequence
  Description of Artificial Sequence: Synthetic primer
aatgtaatcacactactatgatcta

SEQ ID NO: 2944 - DNA, 23 bp, Artificial Sequence
  Description of Artificial Sequence: Synthetic primer
aataatcttaggtcttcttgtat

SEQ ID NO: 2945 - DNA, 23 bp, Artificial Sequence
  Description of Artificial Sequence: Synthetic primer
ccaatttgctgtctgttacttct

SEQ ID NO: 2946 - DNA, 23 bp, Artificial Sequence
  Description of Artificial Sequence: Synthetic primer
acacattttaatgcagataattg

SEQ ID NO: 2947 - DNA, 24 bp, Artificial Sequence
  Description of Artificial Sequence: Synthetic primer
ctaaccaaagaaatgtagatttac

SEQ ID NO: 2948 - DNA, 27 bp, Artificial Sequence
  Description of Artificial Sequence: Synthetic primer
gcccctcttgttactacttcatcattt

SEQ ID NO: 2949 - DNA, 17 bp, Artificial Sequence
  Description of Artificial Sequence: Synthetic primer
cccctccccaatatttc

SEQ ID NO: 2950 - DNA, 25 bp, Artificial Sequence
  Description of Artificial Sequence: Synthetic primer
gcctagttttactgcacacgtcttt

SEQ ID NO: 2951 - DNA, 26 bp, Artificial Sequence
  Description of Artificial Sequence: Synthetic primer
gtctttagagaataaaatatatctgg

SEQ ID NO: 2952 - DNA, 20 bp, Artificial Sequence
  Description of Artificial Sequence: Synthetic primer
tgattgaaattgcttcaagt

SEQ ID NO: 2953 - DNA, 24 bp, Artificial Sequence
  Description of Artificial Sequence: Synthetic primer
gcagttttacttaaatctcactta

SEQ ID NO: 2954 - DNA, 25 bp, Artificial Sequence
  Description of Artificial Sequence: Synthetic primer
tttctagtggaagagtgacagattc

SEQ ID NO: 2955 - DNA, 20 bp, Artificial Sequence
  Description of Artificial Sequence: Synthetic primer
gaatcaaggcctccaaaatt

SEQ ID NO: 2956 - DNA, 17 bp, Artificial Sequence
  Description of Artificial Sequence: Synthetic primer
gaggccttgattcttct

SEQ ID NO: 2957 - DNA, 22 bp, Artificial Sequence
  Description of Artificial Sequence: Synthetic primer
accagatcactgtgcagcaaga

SEQ ID NO: 2958 - DNA, 20 bp, Artificial Sequence
  Description of Artificial Sequence: Synthetic primer
tcccaacatacagtgaatac

SEQ ID NO: 2959 - DNA, 20 bp, Artificial Sequence
  Description of Artificial Sequence: Synthetic primer
tgcctacacattctagatca

SEQ ID NO: 2960 - DNA, 23 bp, Artificial Sequence
  Description of Artificial Sequence: Synthetic primer
gcaaaataaatattggtggttag

SEQ ID NO: 2961 - DNA, 17 bp, Artificial Sequence
  Description of Artificial Sequence: Synthetic primer
ccatacctgccaaccta

SEQ ID NO: 2962 - DNA, 26 bp, Artificial Sequence
  Description of Artificial Sequence: Synthetic primer
atctcttaactaaaagatttagttac

SEQ ID NO: 2963 - DNA, 22 bp, Artificial Sequence
  Description of Artificial Sequence: Synthetic primer
tttatcccaaagacatttttgc

SEQ ID NO: 2964 - DNA, 20 bp, Artificial Sequence
  Description of Artificial Sequence: Synthetic primer
cctggtgagctggagtgggg

SEQ ID NO: 2965 - DNA, 20 bp, Artificial Sequence
  Description of Artificial Sequence: Synthetic primer
cccctttggtgtgcttcttt

SEQ ID NO: 2966 - DNA, 27 bp, Artificial Sequence
  Description of Artificial Sequence: Synthetic primer
cccagaattctctaccagttctcaaga

SEQ ID NO: 2967 - DNA, 25 bp, Artificial Sequence
  Description of Artificial Sequence: Synthetic primer
cctctattaagcttttcaaaagata

SEQ ID NO: 2968 - DNA, 26 bp, Artificial Sequence
  Description of Artificial Sequence: Synthetic primer
gtggctgttatttagcaagtaggtca

SEQ ID NO: 2969 - DNA, 22 bp, Artificial Sequence
  Description of Artificial Sequence: Synthetic primer
cttgctaaataacagccacaag

SEQ ID NO: 2970 - DNA, 21 bp, Artificial Sequence
  Description of Artificial Sequence: Synthetic primer
gacttgttgattcaacaagtt

SEQ ID NO: 2971 - DNA, 22 bp, Artificial Sequence
  Description of Artificial Sequence: Synthetic primer
atgctacacctttaaaaagtca

SEQ ID NO: 2972 - DNA, 18 bp, Artificial Sequence
  Description of Artificial Sequence: Synthetic primer
ggctacctgggaagtggg

SEQ ID NO: 2973 - DNA, 22 bp, Artificial Sequence
  Description of Artificial Sequence: Synthetic primer
ccaccactcaggcagatgccta

SEQ ID NO: 2974 - DNA, 17 bp, Artificial Sequence
  Description of Artificial Sequence: Synthetic primer
aggccctccacctcctc

SEQ ID NO: 2975 - DNA, 18 bp, Artificial Sequence
  Description of Artificial Sequence: Synthetic primer
tgctgtgccttccactcc

SEQ ID NO: 2976 - DNA, 17 bp, Artificial Sequence
  Description of Artificial Sequence: Synthetic primer
tgggcctggagcgggtt

SEQ ID NO: 2977 - DNA, 23 bp, Artificial Sequence
  Description of Artificial Sequence: Synthetic primer
cccaacccggctctgaacgcctc

SEQ ID NO: 2978 - DNA, 26 bp, Artificial Sequence
  Description of Artificial Sequence: Synthetic primer
gctatcttctcccgattgtctaaaaa

SEQ ID NO: 2979 - DNA, 25 bp, Artificial Sequence
  Description of Artificial Sequence: Synthetic primer
gattttaaattcaagaggaggggaa

SEQ ID NO: 2980 - DNA, 19 bp, Artificial Sequence
  Description of Artificial Sequence: Synthetic primer
acaggaagatgggtcagtt

SEQ ID NO: 2981 - DNA, 19 bp, Artificial Sequence
  Description of Artificial Sequence: Synthetic primer
cctctccataaaaagtcac

SEQ ID NO: 2982 - DNA, 20 bp, Artificial Sequence
  Description of Artificial Sequence: Synthetic primer
acttgtcctccaagatcttt

SEQ ID NO: 2983 - DNA, 21 bp, Artificial Sequence
  Description of Artificial Sequence: Synthetic primer
ttcttgggaaggattaaaaga

SEQ ID NO: 2984 - DNA, 27 bp, Artificial Sequence
  Description of Artificial Sequence: Synthetic primer
attcagtaaacatttattcgatacctt

SEQ ID NO: 2985 - DNA, 22 bp, Artificial Sequence
  Description of Artificial Sequence: Synthetic primer
gataatttggggatgttaccag

SEQ ID NO: 2986 - DNA, 25 bp, Artificial Sequence
  Description of Artificial Sequence: Synthetic primer
gagaaatgaccaagagatgaaatac

SEQ ID NO: 2987 - DNA, 24 bp, Artificial Sequence
  Description of Artificial Sequence: Synthetic primer
aaatttgtaaatgccacatatttc

SEQ ID NO: 2988 - DNA, 25 bp, Artificial Sequence
  Description of Artificial Sequence: Synthetic primer
acaacctctattatattacacaaac

SEQ ID NO: 2989 - DNA, 20 bp, Artificial Sequence
  Description of Artificial Sequence: Synthetic primer
tcatggaatgtgcctggata

SEQ ID NO: 2990 - DNA, 22 bp, Artificial Sequence
  Description of Artificial Sequence: Synthetic primer
ataccctacagtgtttttattg

SEQ ID NO: 2991 - DNA, 26 bp, Artificial Sequence
  Description of Artificial Sequence: Synthetic primer
tacctaattaatgctcaatatatgct

SEQ ID NO: 2992 - DNA, 20 bp, Artificial Sequence
  Description of Artificial Sequence: Synthetic primer
gaaccaaacaaggaaaatac

SEQ ID NO: 2993 - DNA, 19 bp, Artificial Sequence
  Description of Artificial Sequence: Synthetic primer
cactgcaaagcatttctta

SEQ ID NO: 2994 - DNA, 23 bp, Artificial Sequence
  Description of Artificial Sequence: Synthetic primer
aaatataaggataaactgccctg

SEQ ID NO: 2995 - DNA, 27 bp, Artificial Sequence
  Description of Artificial Sequence: Synthetic primer
caatcctatcaatttctctctgactca

SEQ ID NO: 2996 - DNA, 24 bp, Artificial Sequence
  Description of Artificial Sequence: Synthetic primer
tacctattaccacacccaaatacc

SEQ ID NO: 2997 - DNA, 26 bp, Artificial Sequence
  Description of Artificial Sequence: Synthetic primer
atctaacaatggaagcatcataaatt

SEQ ID NO: 2998 - DNA, 22 bp, Artificial Sequence
  Description of Artificial Sequence: Synthetic primer
ctgtcattgtcacaaaaatcac

SEQ ID NO: 2999 - DNA, 19 bp, Artificial Sequence
  Description of Artificial Sequence: Synthetic primer
tcagtaaggaattggtgga

SEQ ID NO: 3000 - DNA, 19 bp, Artificial Sequence
  Description of Artificial Sequence: Synthetic primer
tccaccaattccttactga

SEQ ID NO: 3001 - DNA, 26 bp, Artificial Sequence
  Description of Artificial Sequence: Synthetic primer
tttctttgtgtagtgcttttaaaaat

SEQ ID NO: 3002 - DNA, 17 bp, Artificial Sequence
  Description of Artificial Sequence: Synthetic primer
ttcccacacatcttctc

SEQ ID NO: 3003 - DNA, 23 bp, Artificial Sequence
  Description of Artificial Sequence: Synthetic primer
ccctttacttcatttagcttcat

SEQ ID NO: 3004 - DNA, 21 bp, Artificial Sequence
  Description of Artificial Sequence: Synthetic primer
gcttatcacagatccttaaac

SEQ ID NO: 3005 - DNA, 20 bp, Artificial Sequence
  Description of Artificial Sequence: Synthetic primer
tgacagctattttgactttt

SEQ ID NO: 3006 - DNA, 24 bp, Artificial Sequence
  Description of Artificial Sequence: Synthetic primer
aatagctgtcatacagtgtgaatt

SEQ ID NO: 3007 - DNA, 25 bp, Artificial Sequence
  Description of Artificial Sequence: Synthetic primer
tttgtctataaaagagaatctctgg

SEQ ID NO: 3008 - DNA, 25 bp, Artificial Sequence
  Description of Artificial Sequence: Synthetic primer
attatatacatgatcaacaacagca

SEQ ID NO: 3009 - DNA, 22 bp, Artificial Sequence
  Description of Artificial Sequence: Synthetic primer
tataccttcagttacatgttag

SEQ ID NO: 3010 - DNA, 23 bp, Artificial Sequence
  Description of Artificial Sequence: Synthetic primer
ttctactgaaaactgtgttctaa

SEQ ID NO: 3011 - DNA, 26 bp, Artificial Sequence
  Description of Artificial Sequence: Synthetic primer
agtaactcagtacataaatagtagcc

SEQ ID NO: 3012 - DNA, 23 bp, Artificial Sequence
  Description of Artificial Sequence: Synthetic primer
ttcaatctggaagagaagaactt

SEQ ID NO: 3013 - DNA, 22 bp, Artificial Sequence
  Description of Artificial Sequence: Synthetic primer
ccacatatgtaatcatatcacc

SEQ ID NO: 3014 - DNA, 25 bp, Artificial Sequence
  Description of Artificial Sequence: Synthetic primer
ccaggcttaaactaatctcaaatac

SEQ ID NO: 3015 - DNA, 27 bp, Artificial Sequence
  Description of Artificial Sequence: Synthetic primer
ttcctatcttctccaggtctgtgaaac

SEQ ID NO: 3016 - DNA, 21 bp, Artificial Sequence
  Description of Artificial Sequence: Synthetic primer
cctggagaagataggaaaaaa

SEQ ID NO: 3017 - DNA, 18 bp, Artificial Sequence
  Description of Artificial Sequence: Synthetic primer
aacattgctaaggaacag

SEQ ID NO: 3018 - DNA, 22 bp, Artificial Sequence
  Description of Artificial Sequence: Synthetic primer
ttcaatagactaggagaaaaaa

SEQ ID NO: 3019 - DNA, 27 bp, Artificial Sequence
  Description of Artificial Sequence: Synthetic primer
ccttttcatgattcatctatcttagtc

SEQ ID NO: 3020 - DNA, 25 bp, Artificial Sequence
  Description of Artificial Sequence: Synthetic primer
ctgtagaaagatgtaaatagggact

SEQ ID NO: 3021 - DNA, 21 bp, Artificial Sequence
  Description of Artificial Sequence: Synthetic primer
cttttaaacttcaaccaatgt

SEQ ID NO: 3022 - DNA, 25 bp, Artificial Sequence
  Description of Artificial Sequence: Synthetic primer
ttgctacattgaagtatgtagtttt

SEQ ID NO: 3023 - DNA, 22 bp, Artificial Sequence
  Description of Artificial Sequence: Synthetic primer
ttgtttggggcttatttctgtg

SEQ ID NO: 3024 - DNA, 27 bp, Artificial Sequence
  Description of Artificial Sequence: Synthetic primer
tatctaacataaatttttgtttacacc

SEQ ID NO: 3025 - DNA, 26 bp, Artificial Sequence
  Description of Artificial Sequence: Synthetic primer
tgatcatgtaatggcataagcaagta

SEQ ID NO: 3026 - DNA, 26 bp, Artificial Sequence
  Description of Artificial Sequence: Synthetic primer
gccattacatgatcagtttatctttt

SEQ ID NO: 3027 - DNA, 18 bp, Artificial Sequence
  Description of Artificial Sequence: Synthetic primer
gatagtatggtgcctcaa

SEQ ID NO: 3028 - DNA, 23 bp, Artificial Sequence
  Description of Artificial Sequence: Synthetic primer
atgttagcagggtccaactgtct

SEQ ID NO: 3029 - DNA, 26 bp, Artificial Sequence
  Description of Artificial Sequence: Synthetic primer
gtgaggaagagtttgatagtatgtga

SEQ ID NO: 3030 - DNA, 24 bp, Artificial Sequence
  Description of Artificial Sequence: Synthetic primer
ttttggcactcaagggtattaatg

SEQ ID NO: 3031 - DNA, 22 bp, Artificial Sequence
  Description of Artificial Sequence: Synthetic primer
tatttagataccttgggagtta

SEQ ID NO: 3032 - DNA, 20 bp, Artificial Sequence
  Description of Artificial Sequence: Synthetic primer
cactcggcattaaaagaaaa

SEQ ID NO: 3033 - DNA, 25 bp, Artificial Sequence
  Description of Artificial Sequence: Synthetic primer
ccatattaatccaagaacacaataa

SEQ ID NO: 3034 - DNA, 22 bp, Artificial Sequence
  Description of Artificial Sequence: Synthetic primer
atttggagcatggggagcctta

SEQ ID NO: 3035 - DNA, 25 bp, Artificial Sequence
  Description of Artificial Sequence: Synthetic primer
ttttatttcagtcagctttatttca

SEQ ID NO: 3036 - DNA, 21 bp, Artificial Sequence
  Description of Artificial Sequence: Synthetic primer
gtatgccaactagaatgatta

SEQ ID NO: 3037 - DNA, 23 bp, Artificial Sequence
  Description of Artificial Sequence: Synthetic primer
tgtaatgtcgtttgatgttattt

SEQ ID NO: 3038 - DNA, 22 bp, Artificial Sequence
  Description of Artificial Sequence: Synthetic primer
ggtctctgccaaatcactatta

SEQ ID NO: 3039 - DNA, 24 bp, Artificial Sequence
  Description of Artificial Sequence: Synthetic primer
cattgtgtaatgtaagtataatgt

SEQ ID NO: 3040 - DNA, 19 bp, Artificial Sequence
  Description of Artificial Sequence: Synthetic primer
gaggaggcagaatctcaga

SEQ ID NO: 3041 - DNA, 27 bp, Artificial Sequence
  Description of Artificial Sequence: Synthetic primer
actcagaaagcttgcctctcctatttt

SEQ ID NO: 3042 - DNA, 24 bp, Artificial Sequence
  Description of Artificial Sequence: Synthetic primer
tatgtatgttgttacaaatagaga

SEQ ID NO: 3043 - DNA, 21 bp, Artificial Sequence
  Description of Artificial Sequence: Synthetic primer
tgtacctattattcacttgct

SEQ ID NO: 3044 - DNA, 23 bp, Artificial Sequence
  Description of Artificial Sequence: Synthetic primer
atctggttcaccttattgactca

SEQ ID NO: 3045 - DNA, 23 bp, Artificial Sequence
  Description of Artificial Sequence: Synthetic primer
tgttttccacttttcttaaaaaa

SEQ ID NO: 3046 - DNA, 26 bp, Artificial Sequence
  Description of Artificial Sequence: Synthetic primer
tatataaatactcttttgatgcataa

SEQ ID NO: 3047 - DNA, 21 bp, Artificial Sequence
  Description of Artificial Sequence: Synthetic primer
gagaccaggaagttaaatacc

SEQ ID NO: 3048 - DNA, 18 bp, Artificial Sequence
  Description of Artificial Sequence: Synthetic primer
ttgaagatgggagaaaga

SEQ ID NO: 3049 - DNA, 22 bp, Artificial Sequence
  Description of Artificial Sequence: Synthetic primer
ccatcttcaaaaaacttccccc

SEQ ID NO: 3050 - DNA, 25 bp, Artificial Sequence
  Description of Artificial Sequence: Synthetic primer
gtggttcaactgaaagaatgaaaag

SEQ ID NO: 3051 - DNA, 18 bp, Artificial Sequence
  Description of Artificial Sequence: Synthetic primer
aggtctgtcttacctttc

SEQ ID NO: 3052 - DNA, 26 bp, Artificial Sequence
  Description of Artificial Sequence: Synthetic primer
atatttatgacttgaatcccaagcta

SEQ ID NO: 3053 - DNA, 27 bp, Artificial Sequence
  Description of Artificial Sequence: Synthetic primer
cccatttcttttgtaaaagcaacttga

SEQ ID NO: 3054 - DNA, 21 bp, Artificial Sequence
  Description of Artificial Sequence: Synthetic primer
aatctcaggattcatggtatc

SEQ ID NO: 3055 - DNA, 26 bp, Artificial Sequence
  Description of Artificial Sequence: Synthetic primer
taaaagctttgagtgatgtttgatta

SEQ ID NO: 3056 - DNA, 23 bp, Artificial Sequence
  Description of Artificial Sequence: Synthetic primer
tatccctacccattaatactgta

SEQ ID NO: 3057 - DNA, 21 bp, Artificial Sequence
  Description of Artificial Sequence: Synthetic primer
gaatgtcaagctttaggaatt

SEQ ID NO: 3058 - DNA, 22 bp, Artificial Sequence
  Description of Artificial Sequence: Synthetic primer
actgttattctgagttgaatgc

SEQ ID NO: 3059 - DNA, 21 bp, Artificial Sequence
  Description of Artificial Sequence: Synthetic primer
tcaactcagaataacagtaag

SEQ ID NO: 3060 - DNA, 19 bp, Artificial Sequence
  Description of Artificial Sequence: Synthetic primer
gacagtggcatgagccaac

SEQ ID NO: 3061 - DNA, 21 bp, Artificial Sequence
  Description of Artificial Sequence: Synthetic primer
gccactgtccttatttataac

SEQ ID NO: 3062 - DNA, 21 bp, Artificial Sequence
  Description of Artificial Sequence: Synthetic primer
cctttctacttctctgaactc

SEQ ID NO: 3063 - DNA, 22 bp, Artificial Sequence
  Description of Artificial Sequence: Synthetic primer
gtgtttgggtttttgaaaagat

SEQ ID NO: 3064 - DNA, 26 bp, Artificial Sequence
  Description of Artificial Sequence: Synthetic primer
tgaaagccacaggcattgggtggggt

SEQ ID NO: 3065 - DNA, 24 bp, Artificial Sequence
  Description of Artificial Sequence: Synthetic primer
caattttactggttctcttttaga

SEQ ID NO: 3066 - DNA, 21 bp, Artificial Sequence
  Description of Artificial Sequence: Synthetic primer
atctatcataatctcagctgt

SEQ ID NO: 3067 - DNA, 20 bp, Artificial Sequence
  Description of Artificial Sequence: Synthetic primer
tacaaaacctaagcaacctt

SEQ ID NO: 3068 - DNA, 20 bp, Artificial Sequence
  Description of Artificial Sequence: Synthetic primer
aaatgcttttcccacagata

SEQ ID NO: 3069 - DNA, 19 bp, Artificial Sequence
  Description of Artificial Sequence: Synthetic primer
acaggaatgtaggaagatg

SEQ ID NO: 3070 - DNA, 22 bp, Artificial Sequence
  Description of Artificial Sequence: Synthetic primer
aaagtgagagtcaccaacatag

SEQ ID NO: 3071 - DNA, 19 bp, Artificial Sequence
  Description of Artificial Sequence: Synthetic primer
tcctaggaaaaactgatga

SEQ ID NO: 3072 - DNA, 19 bp, Artificial Sequence
  Description of Artificial Sequence: Synthetic primer
agaaagctaaggggaagga

SEQ ID NO: 3073 - DNA, 24 bp, Artificial Sequence
  Description of Artificial Sequence: Synthetic primer
ggagggattatattacacatgtta

SEQ ID NO: 3074 - DNA, 23 bp, Artificial Sequence
  Description of Artificial Sequence: Synthetic primer
agttgcccaaattctgaaaaaaa

SEQ ID NO: 3075 - DNA, 21 bp, Artificial Sequence
  Description of Artificial Sequence: Synthetic primer
attactcctgattcctccttc

SEQ ID NO: 3076 - DNA, 19 bp, Artificial Sequence
  Description of Artificial Sequence: Synthetic primer
gtaatgccaagaatgagaa

SEQ ID NO: 3077 - DNA, 26 bp, Artificial Sequence
  Description of Artificial Sequence: Synthetic primer
aatacccaaagacaagatctctaaag

SEQ ID NO: 3078 - DNA, 25 bp, Artificial Sequence
  Description of Artificial Sequence: Synthetic primer
cttaaaatatcactttaatatgcca

SEQ ID NO: 3079 - DNA, 26 bp, Artificial Sequence
  Description of Artificial Sequence: Synthetic primer
aatgtaggtgcagttcagtaatgatt

SEQ ID NO: 3080 - DNA, 21 bp, Artificial Sequence
  Description of Artificial Sequence: Synthetic primer
gaactgcacctacattaatca

SEQ ID NO: 3081 - DNA, 22 bp, Artificial Sequence
  Description of Artificial Sequence: Synthetic primer
tatctacaaaccaaaaacatct

SEQ ID NO: 3082 - DNA, 25 bp, Artificial Sequence
  Description of Artificial Sequence: Synthetic primer
ttcaggttagaactcagtttcacaa

SEQ ID NO: 3083 - DNA, 20 bp, Artificial Sequence
  Description of Artificial Sequence: Synthetic primer
gtgaatagtgggattacaga

SEQ ID NO: 3084 - DNA, 26 bp, Artificial Sequence
  Description of Artificial Sequence: Synthetic primer
gtagaaactgaagaacactttgttaa

SEQ ID NO: 3085 - DNA, 24 bp, Artificial Sequence
  Description of Artificial Sequence: Synthetic primer
tcctcaaaagagctggagtataaa

SEQ ID NO: 3086 - DNA, 19 bp, Artificial Sequence
  Description of Artificial Sequence: Synthetic primer
ctcccctaccccccacaac

SEQ ID NO: 3087 - DNA, 26 bp, Artificial Sequence
  Description of Artificial Sequence: Synthetic primer
gtagtatgtgagtttggatcatttct

SEQ ID NO: 3088 - DNA, 27 bp, Artificial Sequence
  Description of Artificial Sequence: Synthetic primer
aaactcacatactactacttctttatt

SEQ ID NO: 3089 - DNA, 19 bp, Artificial Sequence
  Description of Artificial Sequence: Synthetic primer
ccatagcccttcattttta

SEQ ID NO: 3090 - DNA, 17 bp, Artificial Sequence
  Description of Artificial Sequence: Synthetic primer
cacatcagaaccaccag

SEQ ID NO: 3091 - DNA, 25 bp, Artificial Sequence
  Description of Artificial Sequence: Synthetic primer
aactacctggcattcaggttaaaat

SEQ ID NO: 3092 - DNA, 17 bp, Artificial Sequence
  Description of Artificial Sequence: Synthetic primer
aagtaggggctggtgat

SEQ ID NO: 3093 - DNA, 23 bp, Artificial Sequence
  Description of Artificial Sequence: Synthetic primer
aataatttttgcatgctaagaaa

SEQ ID NO: 3094 - DNA, 27 bp, Artificial Sequence
  Description of Artificial Sequence: Synthetic primer
ctttatgtgcttacatctgtcatttct

SEQ ID NO: 3095 - DNA, 19 bp, Artificial Sequence
  Description of Artificial Sequence: Synthetic primer
tccagagccggctgagaac

SEQ ID NO: 3096 - DNA, 26 bp, Artificial Sequence
  Description of Artificial Sequence: Synthetic primer
agaagatttttttcagcgggttcctc

SEQ ID NO: 3097 - DNA, 18 bp, Artificial Sequence
  Description of Artificial Sequence: Synthetic primer
tctttgtactttggctgc

SEQ ID NO: 3098 - DNA, 26 bp, Artificial Sequence
  Description of Artificial Sequence: Synthetic primer
agtacaaagagcgccgaggatttcag

SEQ ID NO: 3099 - DNA, 22 bp, Artificial Sequence
  Description of Artificial Sequence: Synthetic primer
caactccgctgcactgtatcca

SEQ ID NO: 3100 - DNA, 26 bp, Artificial Sequence
  Description of Artificial Sequence: Synthetic primer
attccacaatgaacctgccttcacac

SEQ ID NO: 3101 - DNA, 26 bp, Artificial Sequence
  Description of Artificial Sequence: Synthetic primer
aaggcaggttcattgtggaatagttt

SEQ ID NO: 3102 - DNA, 24 bp, Artificial Sequence
  Description of Artificial Sequence: Synthetic primer
aggggaaacagttatattttcaaa

SEQ ID NO: 3103 - DNA, 26 bp, Artificial Sequence
  Description of Artificial Sequence: Synthetic primer
tagatgaaacaggcacacatgcttta

SEQ ID NO: 3104 - DNA, 26 bp, Artificial Sequence
  Description of Artificial Sequence: Synthetic primer
tgcaagcaaaggacagtaagaagttg

SEQ ID NO: 3105 - DNA, 25 bp, Artificial Sequence
  Description of Artificial Sequence: Synthetic primer
aaaaaggaagccataacaaaccaaa

SEQ ID NO: 3106 - DNA, 24 bp, Artificial Sequence
  Description of Artificial Sequence: Synthetic primer
tgcaaatagttttaaaaggaaaat

SEQ ID NO: 3107 - DNA, 20 bp, Artificial Sequence
  Description of Artificial Sequence: Synthetic primer
agagaagactgcctataaca

SEQ ID NO: 3108 - DNA, 20 bp, Artificial Sequence
  Description of Artificial Sequence: Synthetic primer
aagacaatacttttccactt

SEQ ID NO: 3109 - DNA, 22 bp, Artificial Sequence
  Description of Artificial Sequence: Synthetic primer
tgtctttttctttcttttctct

SEQ ID NO: 3110 - DNA, 21 bp, Artificial Sequence
  Description of Artificial Sequence: Synthetic primer
tgacttaactaggagaaaaag

SEQ ID NO: 3111 - DNA, 26 bp, Artificial Sequence
  Description of Artificial Sequence: Synthetic primer
gattaccagagaaagagatcaaagat

SEQ ID NO: 3112 - DNA, 24 bp, Artificial Sequence
  Description of Artificial Sequence: Synthetic primer
atgaaataataaacagaagctcta

SEQ ID NO: 3113 - DNA, 20 bp, Artificial Sequence
  Description of Artificial Sequence: Synthetic primer
aaaaagcatctgatcatgta

SEQ ID NO: 3114 - DNA, 22 bp, Artificial Sequence
  Description of Artificial Sequence: Synthetic primer
aatcaactggagaaattagtca

SEQ ID NO: 3115 - DNA, 22 bp, Artificial Sequence
  Description of Artificial Sequence: Synthetic primer
tgttggcatcagaaaaacaaat

SEQ ID NO: 3116 - DNA, 25 bp, Artificial Sequence
  Description of Artificial Sequence: Synthetic primer
aatcaggggagaaaacaactaaaca

SEQ ID NO: 3117 - DNA, 24 bp, Artificial Sequence
  Description of Artificial Sequence: Synthetic primer
ctcacaaaaatatttggtggtaca

SEQ ID NO: 3118 - DNA, 26 bp, Artificial Sequence
  Description of Artificial Sequence: Synthetic primer
taaatgaggcctgtcattatgtcatc

SEQ ID NO: 3119 - DNA, 21 bp, Artificial Sequence
  Description of Artificial Sequence: Synthetic primer
aaaccatgtgtatttctacaa

SEQ ID NO: 3120 - DNA, 25 bp, Artificial Sequence
  Description of Artificial Sequence: Synthetic primer
ggtagttctctaagttaccaaaatc

SEQ ID NO: 3121 - DNA, 21 bp, Artificial Sequence
  Description of Artificial Sequence: Synthetic primer
aaacataatttggatgggtct

SEQ ID NO: 3122 - DNA, 25 bp, Artificial Sequence
  Description of Artificial Sequence: Synthetic primer
gtagaaaataactttggggtaacaa

SEQ ID NO: 3123 - DNA, 24 bp, Artificial Sequence
  Description of Artificial Sequence: Synthetic primer
gtacattcctttctgtggtatttt

SEQ ID NO: 3124 - DNA, 26 bp, Artificial Sequence
  Description of Artificial Sequence: Synthetic primer
ctggtgagaaggcaataaaaagttga

SEQ ID NO: 3125 - DNA, 19 bp, Artificial Sequence
  Description of Artificial Sequence: Synthetic primer
taaagtctaacaggggaaa

SEQ ID NO: 3126 - DNA, 18 bp, Artificial Sequence
  Description of Artificial Sequence: Synthetic primer
aaacagtgcctttttcat

SEQ ID NO: 3127 - DNA, 19 bp, Artificial Sequence
  Description of Artificial Sequence: Synthetic primer
aagctgtgcagggtaaatg

SEQ ID NO: 3128 - DNA, 27 bp, Artificial Sequence
  Description of Artificial Sequence: Synthetic primer
ctcaagcttttaaaattgaccctgaac

SEQ ID NO: 3129 - DNA, 22 bp, Artificial Sequence
  Description of Artificial Sequence: Synthetic primer
tcaattttaaaagcttgagaag

SEQ ID NO: 3130 - DNA, 23 bp, Artificial Sequence
  Description of Artificial Sequence: Synthetic primer
ccttctgagatgcatcttcaaac

SEQ ID NO: 3131 - DNA, 21 bp, Artificial Sequence
  Description of Artificial Sequence: Synthetic primer
tactctggaagaatttttgaa

SEQ ID NO: 3132 - DNA, 26 bp, Artificial Sequence
  Description of Artificial Sequence: Synthetic primer
ttttttcaaagatcagtaagcggtgc

SEQ ID NO: 3133 - DNA, 23 bp, Artificial Sequence
  Description of Artificial Sequence: Synthetic primer
ggtttttgtagctgtaaactgtg

SEQ ID NO: 3134 - DNA, 22 bp, Artificial Sequence
  Description of Artificial Sequence: Synthetic primer
tacaaaaacctactttggtatt

SEQ ID NO: 3135 - DNA, 23 bp, Artificial Sequence
  Description of Artificial Sequence: Synthetic primer
ttgctgaaggaataacacttaca

SEQ ID NO: 3136 - DNA, 24 bp, Artificial Sequence
  Description of Artificial Sequence: Synthetic primer
catttagaagcttacctgaaatct

SEQ ID NO: 3137 - DNA, 22 bp, Artificial Sequence
  Description of Artificial Sequence: Synthetic primer
catctgtgtaaactttattgag

SEQ ID NO: 3138 - DNA, 22 bp, Artificial Sequence
  Description of Artificial Sequence: Synthetic primer
ggaaacagctttctaatttttt

SEQ ID NO: 3139 - DNA, 20 bp, Artificial Sequence
  Description of Artificial Sequence: Synthetic primer
caagcatctgagaataacat

SEQ ID NO: 3140 - DNA, 18 bp, Artificial Sequence
  Description of Artificial Sequence: Synthetic primer
ttaggctgtaccaacaaa

SEQ ID NO: 3141 - DNA, 26 bp, Artificial Sequence
  Description of Artificial Sequence: Synthetic primer
ccattgtgtgtataatgtttgcctct

SEQ ID NO: 3142 - DNA, 17 bp, Artificial Sequence
  Description of Artificial Sequence: Synthetic primer
ctgtgtacttgtgctct

SEQ ID NO: 3143 - DNA, 17 bp, Artificial Sequence
  Description of Artificial Sequence: Synthetic primer
gacaggcagcagattat

SEQ ID NO: 3144 - DNA, 21 bp, Artificial Sequence
  Description of Artificial Sequence: Synthetic primer
gggttagagttacattttcag

SEQ ID NO: 3145 - DNA, 26 bp, Artificial Sequence
  Description of Artificial Sequence: Synthetic primer
attgggaataaaaagatttatcaatt

SEQ ID NO: 3146 - DNA, 23 bp, Artificial Sequence
  Description of Artificial Sequence: Synthetic primer
tgtgaataaacacaagctgataa

SEQ ID NO: 3147 - DNA, 24 bp, Artificial Sequence
  Description of Artificial Sequence: Synthetic primer
aatggtctgaaaaataaatgctta

SEQ ID NO: 3148 - DNA, 25 bp, Artificial Sequence
  Description of Artificial Sequence: Synthetic primer
acagctatatttcaaacccttttta

SEQ ID NO: 3149 - DNA, 21 bp, Artificial Sequence
  Description of Artificial Sequence: Synthetic primer
agctgttctttatgcataaaa

SEQ ID NO: 3150 - DNA, 25 bp, Artificial Sequence
  Description of Artificial Sequence: Synthetic primer
aaataaattcagattgagacatctt

SEQ ID NO: 3151 - DNA, 19 bp, Artificial Sequence
  Description of Artificial Sequence: Synthetic primer
aatgactggatatcttcct

SEQ ID NO: 3152 - DNA, 17 bp, Artificial Sequence
  Description of Artificial Sequence: Synthetic primer
ccaacaatgaagccatt

SEQ ID NO: 3153 - DNA, 25 bp, Artificial Sequence
  Description of Artificial Sequence: Synthetic primer
taatcatcctcctccttggctggct

SEQ ID NO: 3154 - DNA, 23 bp, Artificial Sequence
  Description of Artificial Sequence: Synthetic primer
gatgccagctcagccatggacac

SEQ ID NO: 3155 - DNA, 22 bp, Artificial Sequence
  Description of Artificial Sequence: Synthetic primer
acttcaaggatctctatgggga

SEQ ID NO: 3156 - DNA, 21 bp, Artificial Sequence
  Description of Artificial Sequence: Synthetic primer
aaaagaaagagcagttacaca

SEQ ID NO: 3157 - DNA, 19 bp, Artificial Sequence
  Description of Artificial Sequence: Synthetic primer
acacctgttccaactgttc

SEQ ID NO: 3158 - DNA, 22 bp, Artificial Sequence
  Description of Artificial Sequence: Synthetic primer
gaacagttggaacaggtgtttg

SEQ ID NO: 3159 - DNA, 18 bp, Artificial Sequence
  Description of Artificial Sequence: Synthetic primer
gatgctcagccctgccag

SEQ ID NO: 3160 - DNA, 19 bp, Artificial Sequence
  Description of Artificial Sequence: Synthetic primer
aatgggaactttttcagag

SEQ ID NO: 3161 - DNA, 18 bp, Artificial Sequence
  Description of Artificial Sequence: Synthetic primer
ataacacccgttggaaag

SEQ ID NO: 3162 - DNA, 20 bp, Artificial Sequence
  Description of Artificial Sequence: Synthetic primer
tgatctcagcataatggtaa

SEQ ID NO: 3163 - DNA, 19 bp, Artificial Sequence
  Description of Artificial Sequence: Synthetic primer
gaagaatgtattgagaggc

SEQ ID NO: 3164 - DNA, 24 bp, Artificial Sequence
  Description of Artificial Sequence: Synthetic primer
gcccaaatccttatgaaggatgac

SEQ ID NO: 3165 - DNA, 19 bp, Artificial Sequence
  Description of Artificial Sequence: Synthetic primer
ccttcttctctactcactt

SEQ ID NO: 3166 - DNA, 26 bp, Artificial Sequence
  Description of Artificial Sequence: Synthetic primer
aagtctactatgattccttagaagtc

SEQ ID NO: 3167 - DNA, 26 bp, Artificial Sequence
  Description of Artificial Sequence: Synthetic primer
gacttctaaggaatcatagtagactt

SEQ ID NO: 3168 - DNA, 21 bp, Artificial Sequence
  Description of Artificial Sequence: Synthetic primer
taacagtccactttataaacc

SEQ ID NO: 3169 - DNA, 17 bp, Artificial Sequence
  Description of Artificial Sequence: Synthetic primer
aaccacaacatctagca

SEQ ID NO: 3170 - DNA, 24 bp, Artificial Sequence
  Description of Artificial Sequence: Synthetic primer
tgttccacctttctaccttttttt

SEQ ID NO: 3171 - DNA, 21 bp, Artificial Sequence
  Description of Artificial Sequence: Synthetic primer
ctgaagtcattcattaggtaa

SEQ ID NO: 3172 - DNA, 23 bp, Artificial Sequence
  Description of Artificial Sequence: Synthetic primer
gaaactgaatgcatttagcatat

SEQ ID NO: 3173 - DNA, 22 bp, Artificial Sequence
  Description of Artificial Sequence: Synthetic primer
tcagtcctcaagttcaccaagt

SEQ ID NO: 3174 - DNA, 24 bp, Artificial Sequence
  Description of Artificial Sequence: Synthetic primer
tccagacaagcaggccaagaaact

SEQ ID NO: 3175 - DNA, 19 bp, Artificial Sequence
  Description of Artificial Sequence: Synthetic primer
atggcacatctgaattact

SEQ ID NO: 3176 - DNA, 21 bp, Artificial Sequence
  Description of Artificial Sequence: Synthetic primer
tgccattgacacaggaggacc

SEQ ID NO: 3177 - DNA, 24 bp, Artificial Sequence
  Description of Artificial Sequence: Synthetic primer
catttaatctggcaattttaattt

SEQ ID NO: 3178 - DNA, 20 bp, Artificial Sequence
  Description of Artificial Sequence: Synthetic primer
tttcctggaaccaggataaa

SEQ ID NO: 3179 - DNA, 21 bp, Artificial Sequence
  Description of Artificial Sequence: Synthetic primer
tgtccatcagcctctctctcc

SEQ ID NO: 3180 - DNA, 20 bp, Artificial Sequence
  Description of Artificial Sequence: Synthetic primer
ggatgctgctgcctggcggt

SEQ ID NO: 3181 - DNA, 23 bp, Artificial Sequence
  Description of Artificial Sequence: Synthetic primer
ggtgagccaatggggtacaaaat

SEQ ID NO: 3182 - DNA, 17 bp, Artificial Sequence
  Description of Artificial Sequence: Synthetic primer
cacactccttccccgcc

SEQ ID NO: 3183 - DNA, 18 bp, Artificial Sequence
  Description of Artificial Sequence: Synthetic primer
ctgtggcaaattttgagt

SEQ ID NO: 3184 - DNA, 17 bp, Artificial Sequence
  Description of Artificial Sequence: Synthetic primer
gcaggcccctcccactc

SEQ ID NO: 3185 - DNA, 26 bp, Artificial Sequence
  Description of Artificial Sequence: Synthetic primer
ctattgtccctccagcctttggccct

SEQ ID NO: 3186 - DNA, 25 bp, Artificial Sequence
  Description of Artificial Sequence: Synthetic primer
tttactggtgcccacaagaaaaaaa

SEQ ID NO: 3187 - DNA, 27 bp, Artificial Sequence
  Description of Artificial Sequence: Synthetic primer
tctccaattttacttttttttttccct

SEQ ID NO: 3188 - DNA, 19 bp, Artificial Sequence
  Description of Artificial Sequence: Synthetic primer
ttaaacccctttaccccaa

SEQ ID NO: 3189 - DNA, 25 bp, Artificial Sequence
  Description of Artificial Sequence: Synthetic primer
gctatcttacttttctttattccac

SEQ ID NO: 3190 - DNA, 24 bp, Artificial Sequence
  Description of Artificial Sequence: Synthetic primer
tccactatttaaaaacaaaacaaa

SEQ ID NO: 3191 - DNA, 26 bp, Artificial Sequence
  Description of Artificial Sequence: Synthetic primer
ttgttttgtttttaaatagtggaaag

SEQ ID NO: 3192 - DNA, 24 bp, Artificial Sequence
  Description of Artificial Sequence: Synthetic primer
aggcaatctttctccataaacata

SEQ ID NO: 3193 - DNA, 22 bp, Artificial Sequence
  Description of Artificial Sequence: Synthetic primer
ttcttgaattttgatcatctct

SEQ ID NO: 3194 - DNA, 26 bp, Artificial Sequence
  Description of Artificial Sequence: Synthetic primer
tgctctttattctatcactttctgct

SEQ ID NO: 3195 - DNA, 21 bp, Artificial Sequence
  Description of Artificial Sequence: Synthetic primer
ggataattatggttggagtgc

SEQ ID NO: 3196 - DNA, 18 bp, Artificial Sequence
  Description of Artificial Sequence: Synthetic primer
agcttagctgcactggtt

SEQ ID NO: 3197 - DNA, 19 bp, Artificial Sequence
  Description of Artificial Sequence: Synthetic primer
accacaacttggcagccac

SEQ ID NO: 3198 - DNA, 21 bp, Artificial Sequence
  Description of Artificial Sequence: Synthetic primer
ctcctcacaacatttggcctt

SEQ ID NO: 3199 - DNA, 17 bp, Artificial Sequence
  Description of Artificial Sequence: Synthetic primer
agttcaggatggcttga

SEQ ID NO: 3200 - DNA, 22 bp, Artificial Sequence
  Description of Artificial Sequence: Synthetic primer
tctttaacatacttctggaaca

SEQ ID NO: 3201 - DNA, 24 bp, Artificial Sequence
  Description of Artificial Sequence: Synthetic primer
tgcattctcccatctgttgaacaa

SEQ ID NO: 3202 - DNA, 26 bp, Artificial Sequence
  Description of Artificial Sequence: Synthetic primer
atatcctggggatggatgtgtgtggc

SEQ ID NO: 3203 - DNA, 21 bp, Artificial Sequence
  Description of Artificial Sequence: Synthetic primer
atttgcattggcctcacagac

SEQ ID NO: 3204 - DNA, 22 bp, Artificial Sequence
  Description of Artificial Sequence: Synthetic primer
acatctagattacaagccttat

SEQ ID NO: 3205 - DNA, 19 bp, Artificial Sequence
  Description of Artificial Sequence: Synthetic primer
ctagatgtagctggtatca

SEQ ID NO: 3206 - DNA, 20 bp, Artificial Sequence
  Description of Artificial Sequence: Synthetic primer
ccagagggtagaagggaggc

SEQ ID NO: 3207 - DNA, 18 bp, Artificial Sequence
  Description of Artificial Sequence: Synthetic primer
gagagcagggacatacgc

SEQ ID NO: 3208 - DNA, 17 bp, Artificial Sequence
  Description of Artificial Sequence: Synthetic primer
cgtatgtccctgctctc

SEQ ID NO: 3209 - DNA, 17 bp, Artificial Sequence
  Description of Artificial Sequence: Synthetic primer
cagtgagactagtgagc

SEQ ID NO: 3210 - DNA, 17 bp, Artificial Sequence
  Description of Artificial Sequence: Synthetic primer
actgctgttgacaacat

SEQ ID NO: 3211 - DNA, 27 bp, Artificial Sequence
  Description of Artificial Sequence: Synthetic primer
caaaacccttgtaaaactttctttctt

SEQ ID NO: 3212 - DNA, 19 bp, Artificial Sequence
  Description of Artificial Sequence: Synthetic primer
ggagagagtgggagataga

SEQ ID NO: 3213 - DNA, 21 bp, Artificial Sequence
  Description of Artificial Sequence: Synthetic primer
tgaaagtaacatcttactagc

SEQ ID NO: 3214 - DNA, 23 bp, Artificial Sequence
  Description of Artificial Sequence: Synthetic primer
tactttcatttacaaatcctaca

SEQ ID NO: 3215 - DNA, 21 bp, Artificial Sequence
  Description of Artificial Sequence: Synthetic primer
tagcaatttaaaagggtaact

SEQ ID NO: 3216 - DNA, 23 bp, Artificial Sequence
  Description of Artificial Sequence: Synthetic primer
aaaaaagtatttgttcctcatgg

SEQ ID NO: 3217 - DNA, 21 bp, Artificial Sequence
  Description of Artificial Sequence: Synthetic primer
gaaggatggagtggggatggt

SEQ ID NO: 3218 - DNA, 17 bp, Artificial Sequence
  Description of Artificial Sequence: Synthetic primer
ccatccttctgcacatc

SEQ ID NO: 3219 - DNA, 18 bp, Artificial Sequence
  Description of Artificial Sequence: Synthetic primer
gcgagatcgagctcaaga

SEQ ID NO: 3220 - DNA, 20 bp, Artificial Sequence
  Description of Artificial Sequence: Synthetic primer
atgacttgagagaggtactt

SEQ ID NO: 3221 - DNA, 19 bp, Artificial Sequence
  Description of Artificial Sequence: Synthetic primer
ccccaaaactccccagtta

SEQ ID NO: 3222 - DNA, 20 bp, Artificial Sequence
  Description of Artificial Sequence: Synthetic primer
ctggggagttttgggggaaa

SEQ ID NO: 3223 - DNA, 21 bp, Artificial Sequence
  Description of Artificial Sequence: Synthetic primer
atggttagtcagcaaagaata

SEQ ID NO: 3224 - DNA, 20 bp, Artificial Sequence
  Description of Artificial Sequence: Synthetic primer
aaccattggttaggtggtgg

SEQ ID NO: 3225 - DNA, 18 bp, Artificial Sequence
  Description of Artificial Sequence: Synthetic primer
acaggcgcctacctgccc

SEQ ID NO: 3226 - DNA, 21 bp, Artificial Sequence
  Description of Artificial Sequence: Synthetic primer
agactagagaaatggcaggga

SEQ ID NO: 3227 - DNA, 18 bp, Artificial Sequence
  Description of Artificial Sequence: Synthetic primer
ctgccatttctctagtct

SEQ ID NO: 3228 - DNA, 19 bp, Artificial Sequence
  Description of Artificial Sequence: Synthetic primer
atgctgacgggtgacttta

SEQ ID NO: 3229 - DNA, 17 bp, Artificial Sequence
  Description of Artificial Sequence: Synthetic primer
aaaccctgctgcttcca

SEQ ID NO: 3230 - DNA, 19 bp, Artificial Sequence
  Description of Artificial Sequence: Synthetic primer
agtgtagcataacaagggg

SEQ ID NO: 3231 - DNA, 25 bp, Artificial Sequence
  Description of Artificial Sequence: Synthetic primer
atgttgggtatgcaatgtacctttt

SEQ ID NO: 3232 - DNA, 23 bp, Artificial Sequence
  Description of Artificial Sequence: Synthetic primer
aacatcaattacatttatcttcc

SEQ ID NO: 3233 - DNA, 22 bp, Artificial Sequence
  Description of Artificial Sequence: Synthetic primer
tcttattccaatgaataactct

SEQ ID NO: 3234 - DNA, 19 bp, Artificial Sequence
  Description of Artificial Sequence: Synthetic primer
tattccccagcattttgta

SEQ ID NO: 3235 - DNA, 24 bp, Artificial Sequence
  Description of Artificial Sequence: Synthetic primer
tagctcaacctctaatttgttctc

SEQ ID NO: 3236 - DNA, 26 bp, Artificial Sequence
  Description of Artificial Sequence: Synthetic primer
ggagcactgcagagaagtcaaaacac

SEQ ID NO: 3237 - DNA, 21 bp, Artificial Sequence
  Description of Artificial Sequence: Synthetic primer
aggcacagagactgcagaatc

SEQ ID NO: 3238 - DNA, 24 bp, Artificial Sequence
  Description of Artificial Sequence: Synthetic primer
agtattttgaaacagaggttaatt

SEQ ID NO: 3239 - DNA, 20 bp, Artificial Sequence
  Description of Artificial Sequence: Synthetic primer
cctctgtttcaaaatactgg

SEQ ID NO: 3240 - DNA, 27 bp, Artificial Sequence
  Description of Artificial Sequence: Synthetic primer
atccaaaccacattgtagattctcaaa

SEQ ID NO: 3241 - DNA, 19 bp, Artificial Sequence
  Description of Artificial Sequence: Synthetic primer
ggaggagaacacatgttgt

SEQ ID NO: 3242 - DNA, 19 bp, Artificial Sequence
  Description of Artificial Sequence: Synthetic primer
tctcaggtctcagcactca

SEQ ID NO: 3243 - DNA, 18 bp, Artificial Sequence
  Description of Artificial Sequence: Synthetic primer
gggccttaatggataacc

SEQ ID NO: 3244 - DNA, 20 bp, Artificial Sequence
  Description of Artificial Sequence: Synthetic primer
ttgggatgcatgacaggatg

SEQ ID NO: 3245 - DNA, 23 bp, Artificial Sequence
  Description of Artificial Sequence: Synthetic primer
aaaatttggagaagaagtaaaaa

SEQ ID NO: 3246 - DNA, 18 bp, Artificial Sequence
  Description of Artificial Sequence: Synthetic primer
aaggatgcacacagctta

SEQ ID NO: 3247 - DNA, 17 bp, Artificial Sequence
  Description of Artificial Sequence: Synthetic primer
cagcagcaacttcaatg

SEQ ID NO: 3248 - DNA, 23 bp, Artificial Sequence
  Description of Artificial Sequence: Synthetic primer
catccaagtctgctgataagcac

SEQ ID NO: 3249 - DNA, 26 bp, Artificial Sequence
  Description of Artificial Sequence: Synthetic primer
ttccaagacaggctttctgttgccca

SEQ ID NO: 3250 - DNA, 25 bp, Artificial Sequence
  Description of Artificial Sequence: Synthetic primer
ttgtctattgagaaacagcagctac

SEQ ID NO: 3251 - DNA, 24 bp, Artificial Sequence
  Description of Artificial Sequence: Synthetic primer
gtaaattctgaatacttagtatgg

SEQ ID NO: 3252 - DNA, 26 bp, Artificial Sequence
  Description of Artificial Sequence: Synthetic primer
ttgattgcccatgtaaatcttgattg

SEQ ID NO: 3253 - DNA, 21 bp, Artificial Sequence
  Description of Artificial Sequence: Synthetic primer
gccatgtcataagtatatctc

SEQ ID NO: 3254 - DNA, 17 bp, Artificial Sequence
  Description of Artificial Sequence: Synthetic primer
ctggagtaaaccctgga

SEQ ID NO: 3255 - DNA, 21 bp, Artificial Sequence
  Description of Artificial Sequence: Synthetic primer
agtttgcaagattttgttttc

SEQ ID NO: 3256 - DNA, 17 bp, Artificial Sequence
  Description of Artificial Sequence: Synthetic primer
agctctacctccttctg

SEQ ID NO: 3257 - DNA, 18 bp, Artificial Sequence
  Description of Artificial Sequence: Synthetic primer
ctctccaacctcctcaag

SEQ ID NO: 3258 - DNA, 26 bp, Artificial Sequence
  Description of Artificial Sequence: Synthetic primer
cgtgtcgtagatgtgccaccgggtcc

SEQ ID NO: 3259 - DNA, 22 bp, Artificial Sequence
  Description of Artificial Sequence: Synthetic primer
tctacctcccaaattaagatac

SEQ ID NO: 3260 - DNA, 26 bp, Artificial Sequence
  Description of Artificial Sequence: Synthetic primer
aatgaaaagaatcaattaaaatggat

SEQ ID NO: 3261 - DNA, 18 bp, Artificial Sequence
  Description of Artificial Sequence: Synthetic primer
aaaacagaaagggagaca

SEQ ID NO: 3262 - DNA, 23 bp, Artificial Sequence
  Description of Artificial Sequence: Synthetic primer
acaacccaagttagatggagcta

SEQ ID NO: 3263 - DNA, 25 bp, Artificial Sequence
  Description of Artificial Sequence: Synthetic primer
tgcttgaatgatagtttaaagaatt

SEQ ID NO: 3264 - DNA, 25 bp, Artificial Sequence
  Description of Artificial Sequence: Synthetic primer
ctttaaactatcattcaagcaaaac

SEQ ID NO: 3265 - DNA, 22 bp, Artificial Sequence
  Description of Artificial Sequence: Synthetic primer
ctgcttcatctaactcgtaggg

SEQ ID NO: 3266 - DNA, 21 bp, Artificial Sequence
  Description of Artificial Sequence: Synthetic primer
aattttccttctgactgtatt

SEQ ID NO: 3267 - DNA, 21 bp, Artificial Sequence
  Description of Artificial Sequence: Synthetic primer
aagaacaaaaagacaacatcc

SEQ ID NO: 3268 - DNA, 26 bp, Artificial Sequence
  Description of Artificial Sequence: Synthetic primer
ttgccaagttctttcaattaatgtta

SEQ ID NO: 3269 - DNA, 23 bp, Artificial Sequence
  Description of Artificial Sequence: Synthetic primer
gggacatgcttctggttagtgga

SEQ ID NO: 3270 - DNA, 22 bp, Artificial Sequence
  Description of Artificial Sequence: Synthetic primer
attagaaaatcaaaagctgact

SEQ ID NO: 3271 - DNA, 19 bp, Artificial Sequence
  Description of Artificial Sequence: Synthetic primer
ccaccttgcattattctaa

SEQ ID NO: 3272 - DNA, 26 bp, Artificial Sequence
  Description of Artificial Sequence: Synthetic primer
tcagtacttgaccattgaagcttttg

SEQ ID NO: 3273 - DNA, 25 bp, Artificial Sequence
  Description of Artificial Sequence: Synthetic primer
aagcttcaatggtcaagtactgaac

SEQ ID NO: 3274 - DNA, 19 bp, Artificial Sequence
  Description of Artificial Sequence: Synthetic primer
aaggaacttgtgccatttt

SEQ ID NO: 3275 - DNA, 21 bp, Artificial Sequence
  Description of Artificial Sequence: Synthetic primer
ttttcatcaccagaaagaatg

SEQ ID NO: 3276 - DNA, 19 bp, Artificial Sequence
  Description of Artificial Sequence: Synthetic primer
aactgcttctgaagaccct

SEQ ID NO: 3277 - DNA, 24 bp, Artificial Sequence
  Description of Artificial Sequence: Synthetic primer
taacctaccagttatgcacctagc

SEQ ID NO: 3278 - DNA, 21 bp, Artificial Sequence
  Description of Artificial Sequence: Synthetic primer
aaaaacaccatttcctccgag

SEQ ID NO: 3279 - DNA, 19 bp, Artificial Sequence
  Description of Artificial Sequence: Synthetic primer
gtgatttcagtaggcttgt

SEQ ID NO: 3280 - DNA, 18 bp, Artificial Sequence
  Description of Artificial Sequence: Synthetic primer
tttgttttccaggagtct

SEQ ID NO: 3281 - DNA, 24 bp, Artificial Sequence
  Description of Artificial Sequence: Synthetic primer
gaggcccatggccaatatcaacag

SEQ ID NO: 3282 - DNA, 19 bp, Artificial Sequence
  Description of Artificial Sequence: Synthetic primer
ggatctctttcctcacaaa

SEQ ID NO: 3283 - DNA, 17 bp, Artificial Sequence
  Description of Artificial Sequence: Synthetic primer
tgaggaaagagatcccc

SEQ ID NO: 3284 - DNA, 24 bp, Artificial Sequence
  Description of Artificial Sequence: Synthetic primer
ggaagcattttgggagttaactac

SEQ ID NO: 3285 - DNA, 23 bp, Artificial Sequence
  Description of Artificial Sequence: Synthetic primer
aggataagtgattctaggaaatg

SEQ ID NO: 3286 - DNA, 20 bp, Artificial Sequence
  Description of Artificial Sequence: Synthetic primer
gacaagggagaagtctcagg

SEQ ID NO: 3287 - DNA, 22 bp, Artificial Sequence
  Description of Artificial Sequence: Synthetic primer
ggaacagtatgtcttcaataat

SEQ ID NO: 3288 - DNA, 24 bp, Artificial Sequence
  Description of Artificial Sequence: Synthetic primer
aatgtaatgaatatgtctacaaag

SEQ ID NO: 3289 - DNA, 20 bp, Artificial Sequence
  Description of Artificial Sequence: Synthetic primer
ctcttagcttccaccttcct

SEQ ID NO: 3290 - DNA, 21 bp, Artificial Sequence
  Description of Artificial Sequence: Synthetic primer
caagttttggacagaaatatg

SEQ ID NO: 3291 - DNA, 21 bp, Artificial Sequence
  Description of Artificial Sequence: Synthetic primer
attttgactttatgttgcacc

SEQ ID NO: 3292 - DNA, 21 bp, Artificial Sequence
  Description of Artificial Sequence: Synthetic primer
ttagaggcatggataggaata

SEQ ID NO: 3293 - DNA, 18 bp, Artificial Sequence
  Description of Artificial Sequence: Synthetic primer
acatgacatctctcatgg

SEQ ID NO: 3294 - DNA, 21 bp, Artificial Sequence
  Description of Artificial Sequence: Synthetic primer
gaggccctgtagatggattac

SEQ ID NO: 3295 - DNA, 17 bp, Artificial Sequence
  Description of Artificial Sequence: Synthetic primer
tccagagtgcaccccaa

SEQ ID NO: 3296 - DNA, 22 bp, Artificial Sequence
  Description of Artificial Sequence: Synthetic primer
cccactaattatccactactaa

SEQ ID NO: 3297 - DNA, 22 bp, Artificial Sequence
  Description of Artificial Sequence: Synthetic primer
ccctgcaggcgcatatccattt

SEQ ID NO: 3298 - DNA, 25 bp, Artificial Sequence
  Description of Artificial Sequence: Synthetic primer
tttactcataatttatttcctctcc

SEQ ID NO: 3299 - DNA, 26 bp, Artificial Sequence
  Description of Artificial Sequence: Synthetic primer
ggagaggaaataaattatgagtaaaa

SEQ ID NO: 3300 - DNA, 21 bp, Artificial Sequence
  Description of Artificial Sequence: Synthetic primer
acaaatgcccatactttattc

SEQ ID NO: 3301 - DNA, 19 bp, Artificial Sequence
  Description of Artificial Sequence: Synthetic primer
tgagaacaaacatttcacc

SEQ ID NO: 3302 - DNA, 18 bp, Artificial Sequence
  Description of Artificial Sequence: Synthetic primer
catggggaggtcaagcag

SEQ ID NO: 3303 - DNA, 17 bp, Artificial Sequence
  Description of Artificial Sequence: Synthetic primer
atatttcccagcccctt

SEQ ID NO: 3304 - DNA, 24 bp, Artificial Sequence
  Description of Artificial Sequence: Synthetic primer
catctgcaacatagcacatgacag

SEQ ID NO: 3305 - DNA, 17 bp, Artificial Sequence
  Description of Artificial Sequence: Synthetic primer
aattggcaaaggagacc

SEQ ID NO: 3306 - DNA, 20 bp, Artificial Sequence
  Description of Artificial Sequence: Synthetic primer
cccgtatagctgacagtgac

SEQ ID NO: 3307 - DNA, 20 bp, Artificial Sequence
  Description of Artificial Sequence: Synthetic primer
ttgtggaggggacgttgacc

SEQ ID NO: 3308 - DNA, 23 bp, Artificial Sequence
  Description of Artificial Sequence: Synthetic primer
gcagataagaaattagaaagtga

SEQ ID NO: 3309 - DNA, 26 bp, Artificial Sequence
  Description of Artificial Sequence: Synthetic primer
ctgcgcagaccactctacagattttt

SEQ ID NO: 3310 - DNA, 26 bp, Artificial Sequence
  Description of Artificial Sequence: Synthetic primer
tgtgaccagcattctgaatatcaagt

SEQ ID NO: 3311 - DNA, 20 bp, Artificial Sequence
  Description of Artificial Sequence: Synthetic primer
gatgagaagctggtgctgaa

SEQ ID NO: 3312 - DNA, 21 bp, Artificial Sequence
  Description of Artificial Sequence: Synthetic primer
agttagagtggtcagtgagga

SEQ ID NO: 3313 - DNA, 25 bp, Artificial Sequence
  Description of Artificial Sequence: Synthetic primer
ttggcttacttaccttaaatattac

SEQ ID NO: 3314 - DNA, 20 bp, Artificial Sequence
  Description of Artificial Sequence: Synthetic primer
actgctacgcaagttatagt

SEQ ID NO: 3315 - DNA, 25 bp, Artificial Sequence
  Description of Artificial Sequence: Synthetic primer
gataccttccaccagactaacctag

SEQ ID NO: 3316 - DNA, 24 bp, Artificial Sequence
  Description of Artificial Sequence: Synthetic primer
acatgggatgtttttaggttttgt

SEQ ID NO: 3317 - DNA, 18 bp, Artificial Sequence
  Description of Artificial Sequence: Synthetic primer
acattcctttgtgtcaga

SEQ ID NO: 3318 - DNA, 25 bp, Artificial Sequence
  Description of Artificial Sequence: Synthetic primer
tccctgctcatgttcttacgatcac

SEQ ID NO: 3319 - DNA, 19 bp, Artificial Sequence
  Description of Artificial Sequence: Synthetic primer
cagtctctccagtcccata

SEQ ID NO: 3320 - DNA, 23 bp, Artificial Sequence
  Description of Artificial Sequence: Synthetic primer
gaaaatagtattgtcctcaaaac

SEQ ID NO: 3321 - DNA, 22 bp, Artificial Sequence
  Description of Artificial Sequence: Synthetic primer
ctattttccagtatccttcaaa

SEQ ID NO: 3322 - DNA, 17 bp, Artificial Sequence
  Description of Artificial Sequence: Synthetic primer
gagcaccacagtgcccc

SEQ ID NO: 3323 - DNA, 18 bp, Artificial Sequence
  Description of Artificial Sequence: Synthetic primer
gcagtgggtacagaatta

SEQ ID NO: 3324 - DNA, 23 bp, Artificial Sequence
  Description of Artificial Sequence: Synthetic primer
taacatctagggaaatttcaggg

SEQ ID NO: 3325 - DNA, 23 bp, Artificial Sequence
  Description of Artificial Sequence: Synthetic primer
tcccacttacacacaatgttcta

SEQ ID NO: 3326 - DNA, 24 bp, Artificial Sequence
  Description of Artificial Sequence: Synthetic primer
atttgagtgtgtgtgtgctctttg

SEQ ID NO: 3327 - DNA, 18 bp, Artificial Sequence
  Description of Artificial Sequence: Synthetic primer
gtatgtgagcgccaatag

SEQ ID NO: 3328 - DNA, 19 bp, Artificial Sequence
  Description of Artificial Sequence: Synthetic primer
cagagctttggtcctcttg

SEQ ID NO: 3329 - DNA, 19 bp, Artificial Sequence
  Description of Artificial Sequence: Synthetic primer
tcccagatcctgaaacctt

SEQ ID NO: 3330 - DNA, 18 bp, Artificial Sequence
  Description of Artificial Sequence: Synthetic primer
atgatttccccaacacag

SEQ ID NO: 3331 - DNA, 20 bp, Artificial Sequence
  Description of Artificial Sequence: Synthetic primer
aaattgaaaggggatgtggg

SEQ ID NO: 3332 - DNA, 25 bp, Artificial Sequence
  Description of Artificial Sequence: Synthetic primer
caccctagttcacaacaccttagca

SEQ ID NO: 3333 - DNA, 23 bp, Artificial Sequence
  Description of Artificial Sequence: Synthetic primer
tcttcatggagcccccattgtag

SEQ ID NO: 3334 - DNA, 24 bp, Artificial Sequence
  Description of Artificial Sequence: Synthetic primer
ctgagcacagaattctcaccctct

SEQ ID NO: 3335 - DNA, 19 bp, Artificial Sequence
  Description of Artificial Sequence: Synthetic primer
ctcaattttccctcaagaa

SEQ ID NO: 3336 - DNA, 17 bp, Artificial Sequence
  Description of Artificial Sequence: Synthetic primer
ggtgggaccccaaaaga

SEQ ID NO: 3337 - DNA, 26 bp, Artificial Sequence
  Description of Artificial Sequence: Synthetic primer
gtaggaactggggaaaaaccttgtgc

SEQ ID NO: 3338 - DNA, 23 bp, Artificial Sequence
  Description of Artificial Sequence: Synthetic primer
tcttcttgagagaaagaataatg

SEQ ID NO: 3339 - DNA, 26 bp, Artificial Sequence
  Description of Artificial Sequence: Synthetic primer
gagtcacacagagagctcacttgtcc

SEQ ID NO: 3340 - DNA, 21 bp, Artificial Sequence
  Description of Artificial Sequence: Synthetic primer
gatgtagagctagacacagca

SEQ ID NO: 3341 - DNA, 25 bp, Artificial Sequence
  Description of Artificial Sequence: Synthetic primer
ctgagggtaacctggtgaatcttct

SEQ ID NO: 3342 - DNA, 26 bp, Artificial Sequence
  Description of Artificial Sequence: Synthetic primer
agtcacattcgggacaggaaccttag

SEQ ID NO: 3343 - DNA, 22 bp, Artificial Sequence
  Description of Artificial Sequence: Synthetic primer
ctgctgtggaaagaagacatag

SEQ ID NO: 3344 - DNA, 27 bp, Artificial Sequence
  Description of Artificial Sequence: Synthetic primer
ggtctccacttgctgtaagctcacact

SEQ ID NO: 3345 - DNA, 17 bp, Artificial Sequence
  Description of Artificial Sequence: Synthetic primer
attcaacacagagcctg

SEQ ID NO: 3346 - DNA, 23 bp, Artificial Sequence
  Description of Artificial Sequence: Synthetic primer
tgtatttgaccacactttatctt

SEQ ID NO: 3347 - DNA, 17 bp, Artificial Sequence
  Description of Artificial Sequence: Synthetic primer
ctcacacccagactcag

SEQ ID NO: 3348 - DNA, 24 bp, Artificial Sequence
  Description of Artificial Sequence: Synthetic primer
gctggagagcggggatcctctggt

SEQ ID NO: 3349 - DNA, 21 bp, Artificial Sequence
  Description of Artificial Sequence: Synthetic primer
atcttgcaaacatttgccaca

SEQ ID NO: 3350 - DNA, 17 bp, Artificial Sequence
  Description of Artificial Sequence: Synthetic primer
tgtggattctctgtacc

SEQ ID NO: 3351 - DNA, 18 bp, Artificial Sequence
  Description of Artificial Sequence: Synthetic primer
aaaggctgaggaatctgt

SEQ ID NO: 3352 - DNA, 25 bp, Artificial Sequence
  Description of Artificial Sequence: Synthetic primer
gttattgtggcataaattaaataag

SEQ ID NO: 3353 - DNA, 19 bp, Artificial Sequence
  Description of Artificial Sequence: Synthetic primer
ctgcagcttcaagctttac

SEQ ID NO: 3354 - DNA, 17 bp, Artificial Sequence
  Description of Artificial Sequence: Synthetic primer
cccctcaccttgctatt

SEQ ID NO: 3355 - DNA, 19 bp, Artificial Sequence
  Description of Artificial Sequence: Synthetic primer
ctgagatactggagaaagt

SEQ ID NO: 3356 - DNA, 23 bp, Artificial Sequence
  Description of Artificial Sequence: Synthetic primer
gtttgtggtctttttgtgaataa

SEQ ID NO: 3357 - DNA, 24 bp, Artificial Sequence
  Description of Artificial Sequence: Synthetic primer
gcatagggttggaaaaattgctta

SEQ ID NO: 3358 - DNA, 21 bp, Artificial Sequence
  Description of Artificial Sequence: Synthetic primer
agcagtatgaaaagacattat

SEQ ID NO: 3359 - DNA, 23 bp, Artificial Sequence
  Description of Artificial Sequence: Synthetic primer
tactgctttgcaatacttcagac

SEQ ID NO: 3360 - DNA, 24 bp, Artificial Sequence
  Description of Artificial Sequence: Synthetic primer
gtaattcaagagtgtactatctta

SEQ ID NO: 3361 - DNA, 17 bp, Artificial Sequence
  Description of Artificial Sequence: Synthetic primer
aaaagtggagcttgggt

SEQ ID NO: 3362 - DNA, 19 bp, Artificial Sequence
  Description of Artificial Sequence: Synthetic primer
ctcaatatgacctccttct

SEQ ID NO: 3363 - DNA, 17 bp, Artificial Sequence
  Description of Artificial Sequence: Synthetic primer
caagcagtggctcttct

SEQ ID NO: 3364 - DNA, 19 bp, Artificial Sequence
  Description of Artificial Sequence: Synthetic primer
agagccactgcttggagag

SEQ ID NO: 3365 - DNA, 21 bp, Artificial Sequence
  Description of Artificial Sequence: Synthetic primer
tttgctgttgaaattcattta

SEQ ID NO: 3366 - DNA, 25 bp, Artificial Sequence
  Description of Artificial Sequence: Synthetic primer
cccctaatccagactcatgggtctc

SEQ ID NO: 3367 - DNA, 19 bp, Artificial Sequence
  Description of Artificial Sequence: Synthetic primer
aagggtcctccaccaattc

SEQ ID NO: 3368 - DNA, 23 bp, Artificial Sequence
  Description of Artificial Sequence: Synthetic primer
gcactgtccaacattaaatatac

SEQ ID NO: 3369 - DNA, 21 bp, Artificial Sequence
  Description of Artificial Sequence: Synthetic primer
aaagctagtaacagagagatt

SEQ ID NO: 3370 - DNA, 23 bp, Artificial Sequence
  Description of Artificial Sequence: Synthetic primer
gctgcttgcagtgcctaccaagt

SEQ ID NO: 3371 - DNA, 24 bp, Artificial Sequence
  Description of Artificial Sequence: Synthetic primer
ccccaaaatgttctgaaaccctgc

SEQ ID NO: 3372 - DNA, 24 bp, Artificial Sequence
  Description of Artificial Sequence: Synthetic primer
ttaacataaagagaggctgaaacc

SEQ ID NO: 3373 - DNA, 17 bp, Artificial Sequence
  Description of Artificial Sequence: Synthetic primer
agaggacctcatggaca

SEQ ID NO: 3374 - DNA, 21 bp, Artificial Sequence
  Description of Artificial Sequence: Synthetic primer
tccccatctcatttaaataac

SEQ ID NO: 3375 - DNA, 25 bp, Artificial Sequence
  Description of Artificial Sequence: Synthetic primer
ccttactgatccccagagtgtcaaa

SEQ ID NO: 3376 - DNA, 23 bp, Artificial Sequence
  Description of Artificial Sequence: Synthetic primer
caagtagtgtctccctttcattc

SEQ ID NO: 3377 - DNA, 22 bp, Artificial Sequence
  Description of Artificial Sequence: Synthetic primer
atcaggatcaagctctcaaaat

SEQ ID NO: 3378 - DNA, 19 bp, Artificial Sequence
  Description of Artificial Sequence: Synthetic primer
ccctacgacctgtcagaaa

SEQ ID NO: 3379 - DNA, 18 bp, Artificial Sequence
  Description of Artificial Sequence: Synthetic primer
taggatgagcaaccaaaa

SEQ ID NO: 3380 - DNA, 26 bp, Artificial Sequence
  Description of Artificial Sequence: Synthetic primer
ctatctggtagatagtggaattttgc

SEQ ID NO: 3381 - DNA, 20 bp, Artificial Sequence
  Description of Artificial Sequence: Synthetic primer
gtctgggccatttttggcta

SEQ ID NO: 3382 - DNA, 25 bp, Artificial Sequence
  Description of Artificial Sequence: Synthetic primer
acagacagagcacctgtgggaggac

SEQ ID NO: 3383 - DNA, 22 bp, Artificial Sequence
  Description of Artificial Sequence: Synthetic primer
aagactcttcttgcagtttaca

SEQ ID NO: 3384 - DNA, 20 bp, Artificial Sequence
  Description of Artificial Sequence: Synthetic primer
gtatagccaccgtcatattc

SEQ ID NO: 3385 - DNA, 22 bp, Artificial Sequence
  Description of Artificial Sequence: Synthetic primer
tgaatctcccttaaagtactta

SEQ ID NO: 3386 - DNA, 27 bp, Artificial Sequence
  Description of Artificial Sequence: Synthetic primer
aatctttattctgactacattctcaat

SEQ ID NO: 3387 - DNA, 19 bp, Artificial Sequence
  Description of Artificial Sequence: Synthetic primer
catcattgggttaccaaaa

SEQ ID NO: 3388 - DNA, 26 bp, Artificial Sequence
  Description of Artificial Sequence: Synthetic primer
aagatgacatgatgatcactttccag

SEQ ID NO: 3389 - DNA, 26 bp, Artificial Sequence
  Description of Artificial Sequence: Synthetic primer
ggctatttacaataactgtatactgg

SEQ ID NO: 3390 - DNA, 17 bp, Artificial Sequence
  Description of Artificial Sequence: Synthetic primer
agggaggtgtttccaaa

SEQ ID NO: 3391 - DNA, 19 bp, Artificial Sequence
  Description of Artificial Sequence: Synthetic primer
tttggaaacacctccctca

SEQ ID NO: 3392 - DNA, 20 bp, Artificial Sequence
  Description of Artificial Sequence: Synthetic primer
tctccttcaaattccacata

SEQ ID NO: 3393 - DNA, 20 bp, Artificial Sequence
  Description of Artificial Sequence: Synthetic primer
aactcttcaaaagggataag

SEQ ID NO: 3394 - DNA, 19 bp, Artificial Sequence
  Description of Artificial Sequence: Synthetic primer
gacctttcttgtttcttct

SEQ ID NO: 3395 - DNA, 21 bp, Artificial Sequence
  Description of Artificial Sequence: Synthetic primer
gatgggctcttcatcatcttc

SEQ ID NO: 3396 - DNA, 20 bp, Artificial Sequence
  Description of Artificial Sequence: Synthetic primer
cttcgaagtgcttgaaaatg

SEQ ID NO: 3397 - DNA, 17 bp, Artificial Sequence
  Description of Artificial Sequence: Synthetic primer
cttgcagcccaaggaaa

SEQ ID NO: 3398 - DNA, 22 bp, Artificial Sequence
  Description of Artificial Sequence: Synthetic primer
ctgcaaggggtagcttgctcat

SEQ ID NO: 3399 - DNA, 17 bp, Artificial Sequence
  Description of Artificial Sequence: Synthetic primer
cgtggaatgtgacttga

SEQ ID NO: 3400 - DNA, 21 bp, Artificial Sequence
  Description of Artificial Sequence: Synthetic primer
ctgatgatgtgtctgtggata

SEQ ID NO: 3401 - DNA, 23 bp, Artificial Sequence
  Description of Artificial Sequence: Synthetic primer
tgtctccctgtgagctatcacct

SEQ ID NO: 3402 - DNA, 26 bp, Artificial Sequence
  Description of Artificial Sequence: Synthetic primer
gaagactcagaagcatcttcctcaag

SEQ ID NO: 3403 - DNA, 19 bp, Artificial Sequence
  Description of Artificial Sequence: Synthetic primer
agcagaacatgcagctttt

SEQ ID NO: 3404 - DNA, 23 bp, Artificial Sequence
  Description of Artificial Sequence: Synthetic primer
cagaagagaaggtatatgaaatt

SEQ ID NO: 3405 - DNA, 19 bp, Artificial Sequence
  Description of Artificial Sequence: Synthetic primer
ggtcctgccagctgcctga

SEQ ID NO: 3406 - DNA, 17 bp, Artificial Sequence
  Description of Artificial Sequence: Synthetic primer
caaggagcatgccaagt

SEQ ID NO: 3407 - DNA, 17 bp, Artificial Sequence
  Description of Artificial Sequence: Synthetic primer
aagccacccctgcagta

SEQ ID NO: 3408 - DNA, 21 bp, Artificial Sequence
  Description of Artificial Sequence: Synthetic primer
gctttttgtcagtttcaaata

SEQ ID NO: 3409 - DNA, 23 bp, Artificial Sequence
  Description of Artificial Sequence: Synthetic primer
ttttgtcttgcactatcaaaata

SEQ ID NO: 3410 - DNA, 18 bp, Artificial Sequence
  Description of Artificial Sequence: Synthetic primer
tttaccaaacagaaccac

SEQ ID NO: 3411 - DNA, 26 bp, Artificial Sequence
  Description of Artificial Sequence: Synthetic primer
aggcttcctgcacaagtggctatgtt

SEQ ID NO: 3412 - DNA, 24 bp, Artificial Sequence
  Description of Artificial Sequence: Synthetic primer
ccttaagttttaaaaagttaggaa

SEQ ID NO: 3413 - DNA, 22 bp, Artificial Sequence
  Description of Artificial Sequence: Synthetic primer
aagaatattaaggagctgtaaa

SEQ ID NO: 3414 - DNA, 17 bp, Artificial Sequence
  Description of Artificial Sequence: Synthetic primer
ggctcctccctcattta

SEQ ID NO: 3415 - DNA, 17 bp, Artificial Sequence
  Description of Artificial Sequence: Synthetic primer
ttccactgactggaatc

SEQ ID NO: 3416 - DNA, 19 bp, Artificial Sequence
  Description of Artificial Sequence: Synthetic primer
aggcatctacagagatgag

SEQ ID NO: 3417 - DNA, 20 bp, Artificial Sequence
  Description of Artificial Sequence: Synthetic primer
caccaacttctttcttcaag

SEQ ID NO: 3418 - DNA, 18 bp, Artificial Sequence
  Description of Artificial Sequence: Synthetic primer
ctctggaagtgagggaga

SEQ ID NO: 3419 - DNA, 20 bp, Artificial Sequence
  Description of Artificial Sequence: Synthetic primer
acgtttctctttcctctcag

SEQ ID NO: 3420 - DNA, 25 bp, Artificial Sequence
  Description of Artificial Sequence: Synthetic primer
acccacttcagtgccagcagcctac

SEQ ID NO: 3421 - DNA, 22 bp, Artificial Sequence
  Description of Artificial Sequence: Synthetic primer
tggcatggggtactatgagagg

SEQ ID NO: 3422 - DNA, 23 bp, Artificial Sequence
  Description of Artificial Sequence: Synthetic primer
ggagttgtaggtattaatacatt

SEQ ID NO: 3423 - DNA, 20 bp, Artificial Sequence
  Description of Artificial Sequence: Synthetic primer
gcttgattctcacacacata

SEQ ID NO: 3424 - DNA, 24 bp, Artificial Sequence
  Description of Artificial Sequence: Synthetic primer
ctgcctttcctgagtaccctccga

SEQ ID NO: 3425 - DNA, 25 bp, Artificial Sequence
  Description of Artificial Sequence: Synthetic primer
tcggagggtactcaggaaaggcagc

SEQ ID NO: 3426 - DNA, 22 bp, Artificial Sequence
  Description of Artificial Sequence: Synthetic primer
acttgtccatccagtccttgtg

SEQ ID NO: 3427 - DNA, 19 bp, Artificial Sequence
  Description of Artificial Sequence: Synthetic primer
tccgtgtcagcccacaacc

SEQ ID NO: 3428 - DNA, 21 bp, Artificial Sequence
  Description of Artificial Sequence: Synthetic primer
tgttgaagttatacctctgaa

SEQ ID NO: 3429 - DNA, 26 bp, Artificial Sequence
  Description of Artificial Sequence: Synthetic primer
tgtatggaaattatagttcaattatt

SEQ ID NO: 3430 - DNA, 26 bp, Artificial Sequence
  Description of Artificial Sequence: Synthetic primer
aattgaactataatttccatacaaca

SEQ ID NO: 3431 - DNA, 25 bp, Artificial Sequence
  Description of Artificial Sequence: Synthetic primer
taacctccctgtttgatattaaaaa

SEQ ID NO: 3432 - DNA, 24 bp, Artificial Sequence
  Description of Artificial Sequence: Synthetic primer
cttagtgatgcatcttattcttta

SEQ ID NO: 3433 - DNA, 26 bp, Artificial Sequence
  Description of Artificial Sequence: Synthetic primer
ggtatttttattggtttgttttatat

SEQ ID NO: 3434 - DNA, 19 bp, Artificial Sequence
  Description of Artificial Sequence: Synthetic primer
aacccaatttcctctttag

SEQ ID NO: 3435 - DNA, 21 bp, Artificial Sequence
  Description of Artificial Sequence: Synthetic primer
aggtggtggtgtcagtaatgg

SEQ ID NO: 3436 - DNA, 26 bp, Artificial Sequence
  Description of Artificial Sequence: Synthetic primer
gggaaatgattagaaatagaaacttc

SEQ ID NO: 3437 - DNA, 25 bp, Artificial Sequence
  Description of Artificial Sequence: Synthetic primer
attttacatagtccttaaaatttgt

SEQ ID NO: 3438 - DNA, 19 bp, Artificial Sequence
  Description of Artificial Sequence: Synthetic primer
taagagtgaagcgaaaatc

SEQ ID NO: 3439 - DNA, 26 bp, Artificial Sequence
  Description of Artificial Sequence: Synthetic primer
agaatggagggatctattagcaaaaa

SEQ ID NO: 3440 - DNA, 25 bp, Artificial Sequence
  Description of Artificial Sequence: Synthetic primer
tgaaaaagagacacatttgcctttg

SEQ ID NO: 3441 - DNA, 20 bp, Artificial Sequence
  Description of Artificial Sequence: Synthetic primer
aaaagggattctggaagtgg

SEQ ID NO: 3442 - DNA, 24 bp, Artificial Sequence
  Description of Artificial Sequence: Synthetic primer
tggggcacatgtattttgtagatt

SEQ ID NO: 3443 - DNA, 17 bp, Artificial Sequence
  Description of Artificial Sequence: Synthetic primer
gcctcagagagtgagaa

SEQ ID NO: 3444 - DNA, 20 bp, Artificial Sequence
  Description of Artificial Sequence: Synthetic primer
accaatttggcagaaagatt

SEQ ID NO: 3445 - DNA, 27 bp, Artificial Sequence
  Description of Artificial Sequence: Synthetic primer
ataattgaatacctcctcatttttctc

SEQ ID NO: 3446 - DNA, 21 bp, Artificial Sequence
  Description of Artificial Sequence: Synthetic primer
acctatttttgctttctagtt

SEQ ID NO: 3447 - DNA, 25 bp, Artificial Sequence
  Description of Artificial Sequence: Synthetic primer
atcaacattcattattccttgcaaa

SEQ ID NO: 3448 - DNA, 17 bp, Artificial Sequence
  Description of Artificial Sequence: Synthetic primer
agtagccacactgaaac

SEQ ID NO: 3449 - DNA, 25 bp, Artificial Sequence
  Description of Artificial Sequence: Synthetic primer
aagattaatcaatttgactacatac

SEQ ID NO: 3450 - DNA, 27 bp, Artificial Sequence
  Description of Artificial Sequence: Synthetic primer
ttacactctgatgtctaacctatacaa

SEQ ID NO: 3451 - DNA, 23 bp, Artificial Sequence
  Description of Artificial Sequence: Synthetic primer
cagttaattctactgggtaaata

SEQ ID NO: 3452 - DNA, 25 bp, Artificial Sequence
  Description of Artificial Sequence: Synthetic primer
atcttctttaccacttttgttttga

SEQ ID NO: 3453 - DNA, 24 bp, Artificial Sequence
  Description of Artificial Sequence: Synthetic primer
tcctatattcctgaattttttttt

SEQ ID NO: 3454 - DNA, 20 bp, Artificial Sequence
  Description of Artificial Sequence: Synthetic primer
tgtcatttggaagaggttac

SEQ ID NO: 3455 - DNA, 26 bp, Artificial Sequence
  Description of Artificial Sequence: Synthetic primer
acagttttcacttttattaaagtaga

SEQ ID NO: 3456 - DNA, 27 bp, Artificial Sequence
  Description of Artificial Sequence: Synthetic primer
aacaaattctacatattatctatgacc

SEQ ID NO: 3457 - DNA, 23 bp, Artificial Sequence
  Description of Artificial Sequence: Synthetic primer
tattattcctatgcatgcttaaa

SEQ ID NO: 3458 - DNA, 22 bp, Artificial Sequence
  Description of Artificial Sequence: Synthetic primer
caaaacattacagtatgaggac

SEQ ID NO: 3459 - DNA, 17 bp, Artificial Sequence
  Description of Artificial Sequence: Synthetic primer
aaacattgagagcaggt

SEQ ID NO: 3460 - DNA, 19 bp, Artificial Sequence
  Description of Artificial Sequence: Synthetic primer
gctgagaaaaaggacttag

SEQ ID NO: 3461 - DNA, 23 bp, Artificial Sequence
  Description of Artificial Sequence: Synthetic primer
agtgtatttcactgaatatatgg

SEQ ID NO: 3462 - DNA, 20 bp, Artificial Sequence
  Description of Artificial Sequence: Synthetic primer
tatgcctacattgctgtatc

SEQ ID NO: 3463 - DNA, 24 bp, Artificial Sequence
  Description of Artificial Sequence: Synthetic primer
accaaaacaatttgcttcattaaa

SEQ ID NO: 3464 - DNA, 20 bp, Artificial Sequence
  Description of Artificial Sequence: Synthetic primer
tccaattctagtaatcctcc

SEQ ID NO: 3465 - DNA, 22 bp, Artificial Sequence
  Description of Artificial Sequence: Synthetic primer
tgaattcactcaaatttccttt

SEQ ID NO: 3466 - DNA, 24 bp, Artificial Sequence
  Description of Artificial Sequence: Synthetic primer
cagtatgtgaatataagcatattt

SEQ ID NO: 3467 - DNA, 21 bp, Artificial Sequence
  Description of Artificial Sequence: Synthetic primer
gttactgagcaaggaaaataa

SEQ ID NO: 3468 - DNA, 26 bp, Artificial Sequence
  Description of Artificial Sequence: Synthetic primer
ttttaaagaaaaagttacagtaattt

SEQ ID NO: 3469 - DNA, 26 bp, Artificial Sequence
  Description of Artificial Sequence: Synthetic primer
tggtttccccatcctagtaaataaca

SEQ ID NO: 3470 - DNA, 20 bp, Artificial Sequence
  Description of Artificial Sequence: Synthetic primer
tatccccattgcaagagata

SEQ ID NO: 3471 - DNA, 26 bp, Artificial Sequence
  Description of Artificial Sequence: Synthetic primer
cggaagaaacaaacaagagccatgat

SEQ ID NO: 3472 - DNA, 20 bp, Artificial Sequence
  Description of Artificial Sequence: Synthetic primer
atttcaggcttcatagtttg

SEQ ID NO: 3473 - DNA, 24 bp, Artificial Sequence
  Description of Artificial Sequence: Synthetic primer
aagtaagacatacacttaaacaaa

SEQ ID NO: 3474 - DNA, 25 bp, Artificial Sequence
  Description of Artificial Sequence: Synthetic primer
atgtggaagaagagtaattggataa

SEQ ID NO: 3475 - DNA, 21 bp, Artificial Sequence
  Description of Artificial Sequence: Synthetic primer
agatttttagatgccttcttc

SEQ ID NO: 3476 - DNA, 23 bp, Artificial Sequence
  Description of Artificial Sequence: Synthetic primer
gcattcatcaagcaactggagat

SEQ ID NO: 3477 - DNA, 18 bp, Artificial Sequence
  Description of Artificial Sequence: Synthetic primer
aagctaattggcacattt

SEQ ID NO: 3478 - DNA, 20 bp, Artificial Sequence
  Description of Artificial Sequence: Synthetic primer
tcaccagggaatctttacta

SEQ ID NO: 3479 - DNA, 17 bp, Artificial Sequence
  Description of Artificial Sequence: Synthetic primer
ctgtcattcagcgacta

SEQ ID NO: 3480 - DNA, 22 bp, Artificial Sequence
  Description of Artificial Sequence: Synthetic primer
agctggatattgaaaaccaaaa

SEQ ID NO: 3481 - DNA, 25 bp, Artificial Sequence
  Description of Artificial Sequence: Synthetic primer
ataccttagaatagtcagaagtcag

SEQ ID NO: 3482 - DNA, 20 bp, Artificial Sequence
  Description of Artificial Sequence: Synthetic primer
tcacttggacacggcctaac

SEQ ID NO: 3483 - DNA, 24 bp, Artificial Sequence
  Description of Artificial Sequence: Synthetic primer
gcacatttgactttctgtacaaca

SEQ ID NO: 3484 - DNA, 21 bp, Artificial Sequence
  Description of Artificial Sequence: Synthetic primer
agtagccagagggcagccagg

SEQ ID NO: 3485 - DNA, 22 bp, Artificial Sequence
  Description of Artificial Sequence: Synthetic primer
agcttcaccagaaacccagagg

SEQ ID NO: 3486 - DNA, 21 bp, Artificial Sequence
  Description of Artificial Sequence: Synthetic primer
cttctctagcctattgtctcc

SEQ ID NO: 3487 - DNA, 17 bp, Artificial Sequence
  Description of Artificial Sequence: Synthetic primer
gccctccaataacaaga

SEQ ID NO: 3488 - DNA, 25 bp, Artificial Sequence
  Description of Artificial Sequence: Synthetic primer
gtcagagacattgtcaaccagacac

SEQ ID NO: 3489 - DNA, 26 bp, Artificial Sequence
  Description of Artificial Sequence: Synthetic primer
tgactttggaggtgggatactgtgtg

SEQ ID NO: 3490 - DNA, 24 bp, Artificial Sequence
  Description of Artificial Sequence: Synthetic primer
cctaaaccttctcatcttgctgtg

SEQ ID NO: 3491 - DNA, 19 bp, Artificial Sequence
  Description of Artificial Sequence: Synthetic primer
agaaggtttaggaggagca

SEQ ID NO: 3492 - DNA, 25 bp, Artificial Sequence
  Description of Artificial Sequence: Synthetic primer
agaaccatgccacccagatattctc

SEQ ID NO: 3493 - DNA, 25 bp, Artificial Sequence
  Description of Artificial Sequence: Synthetic primer
agcaatttcaagctaacagaaagac

SEQ ID NO: 3494 - DNA, 24 bp, Artificial Sequence
  Description of Artificial Sequence: Synthetic primer
tagtctatcttacaggtacttcca

SEQ ID NO: 3495 - DNA, 21 bp, Artificial Sequence
  Description of Artificial Sequence: Synthetic primer
ttgttatccccacttctttaa

SEQ ID NO: 3496 - DNA, 24 bp, Artificial Sequence
  Description of Artificial Sequence: Synthetic primer
cgtaaatcaaaccctttgtcattt

SEQ ID NO: 3497 - DNA, 21 bp, Artificial Sequence
  Description of Artificial Sequence: Synthetic primer
cttcagtttcttgaaatgttt

SEQ ID NO: 3498 - DNA, 27 bp, Artificial Sequence
  Description of Artificial Sequence: Synthetic primer
tcttattatatctggattttaacattt

SEQ ID NO: 3499 - DNA, 26 bp, Artificial Sequence
  Description of Artificial Sequence: Synthetic primer
tgattctgactggtttcctacatata

SEQ ID NO: 3500 - DNA, 23 bp, Artificial Sequence
  Description of Artificial Sequence: Synthetic primer
tgcaaataattagaaagtaaagg

SEQ ID NO: 3501 - DNA, 26 bp, Artificial Sequence
  Description of Artificial Sequence: Synthetic primer
ttactattagacaataatgggttggc

SEQ ID NO: 3502 - DNA, 27 bp, Artificial Sequence
  Description of Artificial Sequence: Synthetic primer
tatagccaataaattactcttatttta

SEQ ID NO: 3503 - DNA, 17 bp, Artificial Sequence
  Description of Artificial Sequence: Synthetic primer
ctatgggtcagttggag

SEQ ID NO: 3504 - DNA, 17 bp, Artificial Sequence
  Description of Artificial Sequence: Synthetic primer
tccaactgacccataga

SEQ ID NO: 3505 - DNA, 21 bp, Artificial Sequence
  Description of Artificial Sequence: Synthetic primer
aaggaagtgaatggatcttac

SEQ ID NO: 3506 - DNA, 22 bp, Artificial Sequence
  Description of Artificial Sequence: Synthetic primer
agcaccacctaaatacttttca

SEQ ID NO: 3507 - DNA, 22 bp, Artificial Sequence
  Description of Artificial Sequence: Synthetic primer
ggccagggtggacactgttact

SEQ ID NO: 3508 - DNA, 21 bp, Artificial Sequence
  Description of Artificial Sequence: Synthetic primer
taagcagcctaggttttcctc

SEQ ID NO: 3509 - DNA, 17 bp, Artificial Sequence
  Description of Artificial Sequence: Synthetic primer
cttgtgggcgatgtcta

SEQ ID NO: 3510 - DNA, 22 bp, Artificial Sequence
  Description of Artificial Sequence: Synthetic primer
taaagctttaacaagttggcga

SEQ ID NO: 3511 - DNA, 23 bp, Artificial Sequence
  Description of Artificial Sequence: Synthetic primer
actccagggctacttgaacaatt

SEQ ID NO: 3512 - DNA, 23 bp, Artificial Sequence
  Description of Artificial Sequence: Synthetic primer
ggaccatgtaatttctttaattc

SEQ ID NO: 3513 - DNA, 25 bp, Artificial Sequence
  Description of Artificial Sequence: Synthetic primer
aaagcatttaaaaaaagattaggag

SEQ ID NO: 3514 - DNA, 25 bp, Artificial Sequence
  Description of Artificial Sequence: Synthetic primer
aatgcttttgtttggtatttgataa

SEQ ID NO: 3515 - DNA, 26 bp, Artificial Sequence
  Description of Artificial Sequence: Synthetic primer
actaagcaagtactagtaaaattatt

SEQ ID NO: 3516 - DNA, 25 bp, Artificial Sequence
  Description of Artificial Sequence: Synthetic primer
ttgaagaatggtatgaagatgataa

SEQ ID NO: 3517 - DNA, 24 bp, Artificial Sequence
  Description of Artificial Sequence: Synthetic primer
acacaaaaatgtaaacattaagga

SEQ ID NO: 3518 - DNA, 22 bp, Artificial Sequence
  Description of Artificial Sequence: Synthetic primer
cagcccaatcaatgaatgaccc

SEQ ID NO: 3519 - DNA, 26 bp, Artificial Sequence
  Description of Artificial Sequence: Synthetic primer
actctctattatttctaattttttca

SEQ ID NO: 3520 - DNA, 26 bp, Artificial Sequence
  Description of Artificial Sequence: Synthetic primer
cagaaaagcttaagcaaaaatgagca

SEQ ID NO: 3521 - DNA, 23 bp, Artificial Sequence
  Description of Artificial Sequence: Synthetic primer
tgttataaacctgatgtttcata

SEQ ID NO: 3522 - DNA, 20 bp, Artificial Sequence
  Description of Artificial Sequence: Synthetic primer
gagtaaaaggaaggaaagga

SEQ ID NO: 3523 - DNA, 21 bp, Artificial Sequence
  Description of Artificial Sequence: Synthetic primer
tgaactactgaatgttagaac

SEQ ID NO: 3524 - DNA, 23 bp, Artificial Sequence
  Description of Artificial Sequence: Synthetic primer
tccattgaagatgaggactccta

SEQ ID NO: 3525 - DNA, 20 bp, Artificial Sequence
  Description of Artificial Sequence: Synthetic primer
ttctcccaaataaaagagga

SEQ ID NO: 3526 - DNA, 26 bp, Artificial Sequence
  Description of Artificial Sequence: Synthetic primer
gtggtagcccatcactgggttgtaaa

SEQ ID NO: 3527 - DNA, 23 bp, Artificial Sequence
  Description of Artificial Sequence: Synthetic primer
tgatccttttaactcaatccaaa

SEQ ID NO: 3528 - DNA, 26 bp, Artificial Sequence
  Description of Artificial Sequence: Synthetic primer
caacaatgtccatgaaaaacttgatt

SEQ ID NO: 3529 - DNA, 25 bp, Artificial Sequence
  Description of Artificial Sequence: Synthetic primer
attgaatctgacaataaatcatatt

SEQ ID NO: 3530 - DNA, 26 bp, Artificial Sequence
  Description of Artificial Sequence: Synthetic primer
atttgaagtagatggtaatgtaatac

SEQ ID NO: 3531 - DNA, 20 bp, Artificial Sequence
  Description of Artificial Sequence: Synthetic primer
tgaccagcatgacaaggtga

SEQ ID NO: 3532 - DNA, 23 bp, Artificial Sequence
  Description of Artificial Sequence: Synthetic primer
tgagcatcagctaatatttaatc

SEQ ID NO: 3533 - DNA, 27 bp, Artificial Sequence
  Description of Artificial Sequence: Synthetic primer
aattaatcatcaggttctttatcctta

SEQ ID NO: 3534 - DNA, 21 bp, Artificial Sequence
  Description of Artificial Sequence: Synthetic primer
gacacgttccagtataaaata

SEQ ID NO: 3535 - DNA, 23 bp, Artificial Sequence
  Description of Artificial Sequence: Synthetic primer
aaggcacagaaagaagtaatatc

SEQ ID NO: 3536 - DNA, 19 bp, Artificial Sequence
  Description of Artificial Sequence: Synthetic primer
ctgtgccttcaaaatttca

SEQ ID NO: 3537 - DNA, 27 bp, Artificial Sequence
  Description of Artificial Sequence: Synthetic primer
tactacgtttttatacttacttttttt

SEQ ID NO: 3538 - DNA, 27 bp, Artificial Sequence
  Description of Artificial Sequence: Synthetic primer
cctgggcaattccttaaataccagata

SEQ ID NO: 3539 - DNA, 23 bp, Artificial Sequence
  Description of Artificial Sequence: Synthetic primer
aggctaaatcttctaaaatcaag

SEQ ID NO: 3540 - DNA, 25 bp, Artificial Sequence
  Description of Artificial Sequence: Synthetic primer
actaaatcaatctcatcatacattc

SEQ ID NO: 3541 - DNA, 20 bp, Artificial Sequence
  Description of Artificial Sequence: Synthetic primer
ctccccaaagtctcagatag

SEQ ID NO: 3542 - DNA, 24 bp, Artificial Sequence
  Description of Artificial Sequence: Synthetic primer
aattgcaaaagccaattaaaaaac

SEQ ID NO: 3543 - DNA, 19 bp, Artificial Sequence
  Description of Artificial Sequence: Synthetic primer
ggcctggctgacagtaaac

SEQ ID NO: 3544 - DNA, 26 bp, Artificial Sequence
  Description of Artificial Sequence: Synthetic primer
taagtggctacgttgttgtcatattg

SEQ ID NO: 3545 - DNA, 24 bp, Artificial Sequence
  Description of Artificial Sequence: Synthetic primer
ccactagtattaacatacagttta

SEQ ID NO: 3546 - DNA, 26 bp, Artificial Sequence
  Description of Artificial Sequence: Synthetic primer
agaaaggtgactaagaattgtagttc

SEQ ID NO: 3547 - DNA, 24 bp, Artificial Sequence
  Description of Artificial Sequence: Synthetic primer
aaaattgatgaatacttagttccc

SEQ ID NO: 3548 - DNA, 19 bp, Artificial Sequence
  Description of Artificial Sequence: Synthetic primer
tgcactggagaaattaaaa

SEQ ID NO: 3549 - DNA, 20 bp, Artificial Sequence
  Description of Artificial Sequence: Synthetic primer
ttaatttctccagtgcagtg

SEQ ID NO: 3550 - DNA, 24 bp, Artificial Sequence
  Description of Artificial Sequence: Synthetic primer
tgtagataatttcctttgtaagta

SEQ ID NO: 3551 - DNA, 24 bp, Artificial Sequence
  Description of Artificial Sequence: Synthetic primer
agtagacaaagaagaaaagtgaag

SEQ ID NO: 3552 - DNA, 21 bp, Artificial Sequence
  Description of Artificial Sequence: Synthetic primer
tagaagacagcatttccatta

SEQ ID NO: 3553 - DNA, 26 bp, Artificial Sequence
  Description of Artificial Sequence: Synthetic primer
cgaatgtcaaaaattttaaaatatca

SEQ ID NO: 3554 - DNA, 26 bp, Artificial Sequence
  Description of Artificial Sequence: Synthetic primer
agaaagaggggaggtaaataataaga

SEQ ID NO: 3555 - DNA, 17 bp, Artificial Sequence
  Description of Artificial Sequence: Synthetic primer
aatgtcagaagccctta

SEQ ID NO: 3556 - DNA, 20 bp, Artificial Sequence
  Description of Artificial Sequence: Synthetic primer
ttctcttggttcaaatttcc

SEQ ID NO: 3557 - DNA, 18 bp, Artificial Sequence
  Description of Artificial Sequence: Synthetic primer
gaggagctagtcagaaca

SEQ ID NO: 3558 - DNA, 22 bp, Artificial Sequence
  Description of Artificial Sequence: Synthetic primer
atgatgtactgtagtaacacac

SEQ ID NO: 3559 - DNA, 17 bp, Artificial Sequence
  Description of Artificial Sequence: Synthetic primer
cagaagtgcaagttcag

SEQ ID NO: 3560 - DNA, 22 bp, Artificial Sequence
  Description of Artificial Sequence: Synthetic primer
gcaagccagtaaataataaaac

SEQ ID NO: 3561 - DNA, 17 bp, Artificial Sequence
  Description of Artificial Sequence: Synthetic primer
tctgcaccacctttctt

SEQ ID NO: 3562 - DNA, 18 bp, Artificial Sequence
  Description of Artificial Sequence: Synthetic primer
agccacggtaactctttc

SEQ ID NO: 3563 - DNA, 25 bp, Artificial Sequence
  Description of Artificial Sequence: Synthetic primer
cgccgcacatcccctctcgcccctc

SEQ ID NO: 3564 - DNA, 20 bp, Artificial Sequence
  Description of Artificial Sequence: Synthetic primer
gtccaagtttagtgaagatg

SEQ ID NO: 3565 - DNA, 17 bp, Artificial Sequence
  Description of Artificial Sequence: Synthetic primer
cagtgctgccagtcaac

SEQ ID NO: 3566 - DNA, 20 bp, Artificial Sequence
  Description of Artificial Sequence: Synthetic primer
tgatcccacgctgctactca

SEQ ID NO: 3567 - DNA, 22 bp, Artificial Sequence
  Description of Artificial Sequence: Synthetic primer
cgaaagcaacggggaaaaaaaa

SEQ ID NO: 3568 - DNA, 25 bp, Artificial Sequence
  Description of Artificial Sequence: Synthetic primer
ctgatttcccagcacccactgtccc

SEQ ID NO: 3569 - DNA, 26 bp, Artificial Sequence
  Description of Artificial Sequence: Synthetic primer
atagtctatacgtgcagtgcagggtt

SEQ ID NO: 3570 - DNA, 24 bp, Artificial Sequence
  Description of Artificial Sequence: Synthetic primer
ttgaatttaactgctccagtaagg

SEQ ID NO: 3571 - DNA, 21 bp, Artificial Sequence
  Description of Artificial Sequence: Synthetic primer
aagagaaacaacataatctga

SEQ ID NO: 3572 - DNA, 17 bp, Artificial Sequence
  Description of Artificial Sequence: Synthetic primer
gggccttgccattctca

SEQ ID NO: 3573 - DNA, 21 bp, Artificial Sequence
  Description of Artificial Sequence: Synthetic primer
gctaattagtgctattggctg

SEQ ID NO: 3574 - DNA, 24 bp, Artificial Sequence
  Description of Artificial Sequence: Synthetic primer
aacataagattaggaacaagaata

SEQ ID NO: 3575 - DNA, 27 bp, Artificial Sequence
  Description of Artificial Sequence: Synthetic primer
ctttgcatatttctttttacgaaacgc

SEQ ID NO: 3576 - DNA, 22 bp, Artificial Sequence
  Description of Artificial Sequence: Synthetic primer
acggaataggaaaatttctcca

SEQ ID NO: 3577 - DNA, 26 bp, Artificial Sequence
  Description of Artificial Sequence: Synthetic primer
ctcttagccctttcacagcatttgat

SEQ ID NO: 3578 - DNA, 18 bp, Artificial Sequence
  Description of Artificial Sequence: Synthetic primer
ggtaaggtggcaagtcaa

SEQ ID NO: 3579 - DNA, 24 bp, Artificial Sequence
  Description of Artificial Sequence: Synthetic primer
aaaacgtggaaaatacaaaaaaaa

SEQ ID NO: 3580 - DNA, 25 bp, Artificial Sequence
  Description of Artificial Sequence: Synthetic primer
ttagccttttccctgctttgatttt

SEQ ID NO: 3581 - DNA, 26 bp, Artificial Sequence
  Description of Artificial Sequence: Synthetic primer
ttgtagaattggagttaagataggat

SEQ ID NO: 3582 - DNA, 22 bp, Artificial Sequence
  Description of Artificial Sequence: Synthetic primer
cacagtaagagccactcggaca

SEQ ID NO: 3583 - DNA, 19 bp, Artificial Sequence
  Description of Artificial Sequence: Synthetic primer
gtgcccggctgaggtgcgt

SEQ ID NO: 3584 - DNA, 17 bp, Artificial Sequence
  Description of Artificial Sequence: Synthetic primer
cccgcaagagggcaaag

SEQ ID NO: 3585 - DNA, 21 bp, Artificial Sequence
  Description of Artificial Sequence: Synthetic primer
ctggagctgggaggggtttga

SEQ ID NO: 3586 - DNA, 17 bp, Artificial Sequence
  Description of Artificial Sequence: Synthetic primer
tgtggcttttagggcga

SEQ ID NO: 3587 - DNA, 24 bp, Artificial Sequence
  Description of Artificial Sequence: Synthetic primer
gttgggcagacttctgtggagacc

SEQ ID NO: 3588 - DNA, 17 bp, Artificial Sequence
  Description of Artificial Sequence: Synthetic primer
tgcctgtgtccacctaa

SEQ ID NO: 3589 - DNA, 20 bp, Artificial Sequence
  Description of Artificial Sequence: Synthetic primer
tcctccctataccggtacaa

SEQ ID NO: 3590 - DNA, 18 bp, Artificial Sequence
  Description of Artificial Sequence: Synthetic primer
tggcaatccacagggagc

SEQ ID NO: 3591 - DNA, 19 bp, Artificial Sequence
  Description of Artificial Sequence: Synthetic primer
tggacttgttgaggaggct

SEQ ID NO: 3592 - DNA, 25 bp, Artificial Sequence
  Description of Artificial Sequence: Synthetic primer
gcacacctgcctgctcctcttggac

SEQ ID NO: 3593 - DNA, 17 bp, Artificial Sequence
  Description of Artificial Sequence: Synthetic primer
aggacagggtctgtgtt

SEQ ID NO: 3594 - DNA, 19 bp, Artificial Sequence
  Description of Artificial Sequence: Synthetic primer
gatctggtagtcagagaag

SEQ ID NO: 3595 - DNA, 18 bp, Artificial Sequence
  Description of Artificial Sequence: Synthetic primer
ggggcctcagcaccctca

SEQ ID NO: 3596 - DNA, 22 bp, Artificial Sequence
  Description of Artificial Sequence: Synthetic primer
gggtgctgaggcccccagtgag

SEQ ID NO: 3597 - DNA, 17 bp, Artificial Sequence
  Description of Artificial Sequence: Synthetic primer
tcgctcacactgtcctc

SEQ ID NO: 3598 - DNA, 23 bp, Artificial Sequence
  Description of Artificial Sequence: Synthetic primer
ccagccccaccgcacaggcccac

SEQ ID NO: 3599 - DNA, 25 bp, Artificial Sequence
  Description of Artificial Sequence: Synthetic primer
gccatgggctggagggcatgatggg

SEQ ID NO: 3600 - DNA, 18 bp, Artificial Sequence
  Description of Artificial Sequence: Synthetic primer
catccagcactttgatga

SEQ ID NO: 3601 - DNA, 17 bp, Artificial Sequence
  Description of Artificial Sequence: Synthetic primer
tccaggcctcagctccg

SEQ ID NO: 3602 - DNA, 23 bp, Artificial Sequence
  Description of Artificial Sequence: Synthetic primer
ctggggtgggcatcaggcctgtg

SEQ ID NO: 3603 - DNA, 17 bp, Artificial Sequence
  Description of Artificial Sequence: Synthetic primer
ctgatgcccaccccagc

SEQ ID NO: 3604 - DNA, 18 bp, Artificial Sequence
  Description of Artificial Sequence: Synthetic primer
cgtgagggtggaggccag

SEQ ID NO: 3605 - DNA, 17 bp, Artificial Sequence
  Description of Artificial Sequence: Synthetic primer
cacggctgacatctagg

SEQ ID NO: 3606 - DNA, 19 bp, Artificial Sequence
  Description of Artificial Sequence: Synthetic primer
gagaggggtcttatcagcc

SEQ ID NO: 3607 - DNA, 19 bp, Artificial Sequence
  Description of Artificial Sequence: Synthetic primer
gcagctcaccaagcaccac

SEQ ID NO: 3608 - DNA, 22 bp, Artificial Sequence
  Description of Artificial Sequence: Synthetic primer
ccaggaccgcatccaacagaga

SEQ ID NO: 3609 - DNA, 19 bp, Artificial Sequence
  Description of Artificial Sequence: Synthetic primer
cacttcctgacacggcccc

SEQ ID NO: 3610 - DNA, 17 bp, Artificial Sequence
  Description of Artificial Sequence: Synthetic primer
gctggcctcaggcctta

SEQ ID NO: 3611 - DNA, 17 bp, Artificial Sequence
  Description of Artificial Sequence: Synthetic primer
cccctcctgtaccttgg

SEQ ID NO: 3612 - DNA, 17 bp, Artificial Sequence
  Description of Artificial Sequence: Synthetic primer
tcaagcacctcattctc

SEQ ID NO: 3613 - DNA, 22 bp, Artificial Sequence
  Description of Artificial Sequence: Synthetic primer
gagaatgaggtgcttgatgatg

SEQ ID NO: 3614 - DNA, 23 bp, Artificial Sequence
  Description of Artificial Sequence: Synthetic primer
ccaccatttctgtgaagctttct

SEQ ID NO: 3615 - DNA, 19 bp, Artificial Sequence
  Description of Artificial Sequence: Synthetic primer
ctttgttcgtgggtagtgt

SEQ ID NO: 3616 - DNA, 23 bp, Artificial Sequence
  Description of Artificial Sequence: Synthetic primer
gaaagacagacaagaacatctta

SEQ ID NO: 3617 - DNA, 20 bp, Artificial Sequence
  Description of Artificial Sequence: Synthetic primer
aactgactgtcataagagat

SEQ ID NO: 3618 - DNA, 26 bp, Artificial Sequence
  Description of Artificial Sequence: Synthetic primer
gggtttccttgagggctaagattact

SEQ ID NO: 3619 - DNA, 22 bp, Artificial Sequence
  Description of Artificial Sequence: Synthetic primer
ggatgcagttctggaaacaaga

SEQ ID NO: 3620 - DNA, 17 bp, Artificial Sequence
  Description of Artificial Sequence: Synthetic primer
tgaatggctcatcccag

SEQ ID NO: 3621 - DNA, 17 bp, Artificial Sequence
  Description of Artificial Sequence: Synthetic primer
tgaagtggtggtggttg

SEQ ID NO: 3622 - DNA, 26 bp, Artificial Sequence
  Description of Artificial Sequence: Synthetic primer
gaatgtgcatgggaaggttctggaat

SEQ ID NO: 3623 - DNA, 17 bp, Artificial Sequence
  Description of Artificial Sequence: Synthetic primer
tggcattcagagagcat

SEQ ID NO: 3624 - DNA, 20 bp, Artificial Sequence
  Description of Artificial Sequence: Synthetic primer
ggataaaaaagcaagactct

SEQ ID NO: 3625 - DNA, 23 bp, Artificial Sequence
  Description of Artificial Sequence: Synthetic primer
tcttgtcaggtgtccttgaaatt

SEQ ID NO: 3626 - DNA, 18 bp, Artificial Sequence
  Description of Artificial Sequence: Synthetic primer
tagacccagagtcccata

SEQ ID NO: 3627 - DNA, 18 bp, Artificial Sequence
  Description of Artificial Sequence: Synthetic primer
gagtgggaagaatacagt

SEQ ID NO: 3628 - DNA, 24 bp, Artificial Sequence
  Description of Artificial Sequence: Synthetic primer
gaaggttgcaaagaggggtggaat

SEQ ID NO: 3629 - DNA, 18 bp, Artificial Sequence
  Description of Artificial Sequence: Synthetic primer
aacagcccaaggtcttac

SEQ ID NO: 3630 - DNA, 20 bp, Artificial Sequence
  Description of Artificial Sequence: Synthetic primer
acagtgagaattttggtctg

SEQ ID NO: 3631 - DNA, 24 bp, Artificial Sequence
  Description of Artificial Sequence: Synthetic primer
gcactggctccaatctgatcaatt

SEQ ID NO: 3632 - DNA, 18 bp, Artificial Sequence
  Description of Artificial Sequence: Synthetic primer
cacctgtcaccaagacac

SEQ ID NO: 3633 - DNA, 17 bp, Artificial Sequence
  Description of Artificial Sequence: Synthetic primer
tctttccagattcccca

SEQ ID NO: 3634 - DNA, 18 bp, Artificial Sequence
  Description of Artificial Sequence: Synthetic primer
tcccttctgagaagtcta

SEQ ID NO: 3635 - DNA, 26 bp, Artificial Sequence
  Description of Artificial Sequence: Synthetic primer
ggaatacattggctgtatgtgatttt

SEQ ID NO: 3636 - DNA, 19 bp, Artificial Sequence
  Description of Artificial Sequence: Synthetic primer
cttgccttcaaagcaaaag

SEQ ID NO: 3637 - DNA, 21 bp, Artificial Sequence
  Description of Artificial Sequence: Synthetic primer
atacaccacaatgctaaaaaa

SEQ ID NO: 3638 - DNA, 20 bp, Artificial Sequence
  Description of Artificial Sequence: Synthetic primer
tctgtgctgcgcctggctct

SEQ ID NO: 3639 - DNA, 19 bp, Artificial Sequence
  Description of Artificial Sequence: Synthetic primer
acggaatgagccgagagtg

SEQ ID NO: 3640 - DNA, 17 bp, Artificial Sequence
  Description of Artificial Sequence: Synthetic primer
ctctcggctcattccgt

SEQ ID NO: 3641 - DNA, 17 bp, Artificial Sequence
  Description of Artificial Sequence: Synthetic primer
ccgagactggggagggg

SEQ ID NO: 3642 - DNA, 26 bp, Artificial Sequence
  Description of Artificial Sequence: Synthetic primer
gaggggactgagggctgagctgcaga

SEQ ID NO: 3643 - DNA, 21 bp, Artificial Sequence
  Description of Artificial Sequence: Synthetic primer
atgtgcaataaaggacaaaaa

SEQ ID NO: 3644 - DNA, 26 bp, Artificial Sequence
  Description of Artificial Sequence: Synthetic primer
tattgcacatttcagaaacagtattt

SEQ ID NO: 3645 - DNA, 25 bp, Artificial Sequence
  Description of Artificial Sequence: Synthetic primer
atgtgaaatatttgtaagtagaaaa

SEQ ID NO: 3646 - DNA, 26 bp, Artificial Sequence
  Description of Artificial Sequence: Synthetic primer
agaaacagcagaaagattttttacag

SEQ ID NO: 3647 - DNA, 26 bp, Artificial Sequence
  Description of Artificial Sequence: Synthetic primer
aaacattgccccataaagtttcccaa

SEQ ID NO: 3648 - DNA, 21 bp, Artificial Sequence
  Description of Artificial Sequence: Synthetic primer
tattcaccagaactcccaaaa

SEQ ID NO: 3649 - DNA, 20 bp, Artificial Sequence
  Description of Artificial Sequence: Synthetic primer
tttgggagttctggtgaata

SEQ ID NO: 3650 - DNA, 17 bp, Artificial Sequence
  Description of Artificial Sequence: Synthetic primer
atcttccagaggacaca

SEQ ID NO: 3651 - DNA, 19 bp, Artificial Sequence
  Description of Artificial Sequence: Synthetic primer
ctgctcctttgagaagctg

SEQ ID NO: 3652 - DNA, 17 bp, Artificial Sequence
  Description of Artificial Sequence: Synthetic primer
ctgcactgtgccccact

SEQ ID NO: 3653 - DNA, 26 bp, Artificial Sequence
  Description of Artificial Sequence: Synthetic primer
ttccctcagacacctggagtctcctt

SEQ ID NO: 3654 - DNA, 17 bp, Artificial Sequence
  Description of Artificial Sequence: Synthetic primer
acccactcctgaacata

SEQ ID NO: 3655 - DNA, 22 bp, Artificial Sequence
  Description of Artificial Sequence: Synthetic primer
gtaaaactttgtcgtgggagga

SEQ ID NO: 3656 - DNA, 17 bp, Artificial Sequence
  Description of Artificial Sequence: Synthetic primer
cagctttcctcctagag

SEQ ID NO: 3657 - DNA, 17 bp, Artificial Sequence
  Description of Artificial Sequence: Synthetic primer
gcacctgtgtatgttct

SEQ ID NO: 3658 - DNA, 17 bp, Artificial Sequence
  Description of Artificial Sequence: Synthetic primer
agactcctggcttatct

SEQ ID NO: 3659 - DNA, 26 bp, Artificial Sequence
  Description of Artificial Sequence: Synthetic primer
acctgatcataatctcttctgattgt

SEQ ID NO: 3660 - DNA, 24 bp, Artificial Sequence
  Description of Artificial Sequence: Synthetic primer
actctactccactaacagtttaca

SEQ ID NO: 3661 - DNA, 27 bp, Artificial Sequence
  Description of Artificial Sequence: Synthetic primer
agatcccgaatctagctgtaatatccc

SEQ ID NO: 3662 - DNA, 26 bp, Artificial Sequence
  Description of Artificial Sequence: Synthetic primer
ggagactcaaactggtcaataagcta

SEQ ID NO: 3663 - DNA, 22 bp, Artificial Sequence
  Description of Artificial Sequence: Synthetic primer
aataataacttctcttctgtcc

SEQ ID NO: 3664 - DNA, 26 bp, Artificial Sequence
  Description of Artificial Sequence: Synthetic primer
acagaagagaagttattatttgtatt

SEQ ID NO: 3665 - DNA, 23 bp, Artificial Sequence
  Description of Artificial Sequence: Synthetic primer
gcttagaaaagataaaactgaaa

SEQ ID NO: 3666 - DNA, 17 bp, Artificial Sequence
  Description of Artificial Sequence: Synthetic primer
gcgcagatccaccctct

SEQ ID NO: 3667 - DNA, 24 bp, Artificial Sequence
  Description of Artificial Sequence: Synthetic primer
gaattgcagttaacagttcctttc

SEQ ID NO: 3668 - DNA, 27 bp, Artificial Sequence
  Description of Artificial Sequence: Synthetic primer
tttcccctttggctttttcaatcatct

SEQ ID NO: 3669 - DNA, 20 bp, Artificial Sequence
  Description of Artificial Sequence: Synthetic primer
tcaaaacaaggacaatctaa

SEQ ID NO: 3670 - DNA, 26 bp, Artificial Sequence
  Description of Artificial Sequence: Synthetic primer
aaaaccaacatggtaaaatctaaata

SEQ ID NO: 3671 - DNA, 23 bp, Artificial Sequence
  Description of Artificial Sequence: Synthetic primer
gtccttgccttatcaccaccatt

SEQ ID NO: 3672 - DNA, 26 bp, Artificial Sequence
  Description of Artificial Sequence: Synthetic primer
ttcctgtagaaagagttaaagtgaat

SEQ ID NO: 3673 - DNA, 22 bp, Artificial Sequence
  Description of Artificial Sequence: Synthetic primer
aacagaagtaccttttgcttat

SEQ ID NO: 3674 - DNA, 22 bp, Artificial Sequence
  Description of Artificial Sequence: Synthetic primer
atatggctgagaagtggggtga

SEQ ID NO: 3675 - DNA, 20 bp, Artificial Sequence
  Description of Artificial Sequence: Synthetic primer
taagttaaagtgggtcaggt

SEQ ID NO: 3676 - DNA, 19 bp, Artificial Sequence
  Description of Artificial Sequence: Synthetic primer
ctaacctgctacctacctt

SEQ ID NO: 3677 - DNA, 24 bp, Artificial Sequence
  Description of Artificial Sequence: Synthetic primer
gttataaatcagtaagaaacagga

SEQ ID NO: 3678 - DNA, 24 bp, Artificial Sequence
  Description of Artificial Sequence: Synthetic primer
gctgaggaacacagctcccttatg

SEQ ID NO: 3679 - DNA, 24 bp, Artificial Sequence
  Description of Artificial Sequence: Synthetic primer
aacagattagattccatgtaacta

SEQ ID NO: 3680 - DNA, 20 bp, Artificial Sequence
  Description of Artificial Sequence: Synthetic primer
gtgtctacaagcataatgaa

SEQ ID NO: 3681 - DNA, 25 bp, Artificial Sequence
  Description of Artificial Sequence: Synthetic primer
cttcttagaagtttctcttctagat

SEQ ID NO: 3682 - DNA, 19 bp, Artificial Sequence
  Description of Artificial Sequence: Synthetic primer
acttgcttgcatcatacat

SEQ ID NO: 3683 - DNA, 17 bp, Artificial Sequence
  Description of Artificial Sequence: Synthetic primer
acttcctcccctgagtc

SEQ ID NO: 3684 - DNA, 19 bp, Artificial Sequence
  Description of Artificial Sequence: Synthetic primer
cgtatctcctgaaatcctg

SEQ ID NO: 3685 - DNA, 17 bp, Artificial Sequence
  Description of Artificial Sequence: Synthetic primer
cagtggtggtaagacaa

SEQ ID NO: 3686 - DNA, 21 bp, Artificial Sequence
  Description of Artificial Sequence: Synthetic primer
aattcatatgctttgctactc

SEQ ID NO: 3687 - DNA, 22 bp, Artificial Sequence
  Description of Artificial Sequence: Synthetic primer
gtagcaaagcatatgaatttta

SEQ ID NO: 3688 - DNA, 22 bp, Artificial Sequence
  Description of Artificial Sequence: Synthetic primer
aacttttatatccttctcatgt

SEQ ID NO: 3689 - DNA, 25 bp, Artificial Sequence
  Description of Artificial Sequence: Synthetic primer
gaaggatataaaagtttgttttctg

SEQ ID NO: 3690 - DNA, 23 bp, Artificial Sequence
  Description of Artificial Sequence: Synthetic primer
gccatagatgagatctccaacct

SEQ ID NO: 3691 - DNA, 23 bp, Artificial Sequence
  Description of Artificial Sequence: Synthetic primer
agagtatgaagcagttgtggagc

SEQ ID NO: 3692 - DNA, 17 bp, Artificial Sequence
  Description of Artificial Sequence: Synthetic primer
tcaagctttgggtgaat

SEQ ID NO: 3693 - DNA, 21 bp, Artificial Sequence
  Description of Artificial Sequence: Synthetic primer
gcatttcatctactcagttac

SEQ ID NO: 3694 - DNA, 21 bp, Artificial Sequence
  Description of Artificial Sequence: Synthetic primer
gtaactgagtagatgaaatgc

SEQ ID NO: 3695 - DNA, 26 bp, Artificial Sequence
  Description of Artificial Sequence: Synthetic primer
atctttaattattccactttttgtta

SEQ ID NO: 3696 - DNA, 26 bp, Artificial Sequence
  Description of Artificial Sequence: Synthetic primer
gtttatttgatcatgtattatccctt

SEQ ID NO: 3697 - DNA, 25 bp, Artificial Sequence
  Description of Artificial Sequence: Synthetic primer
ttggcctaaaaatgaggtttttttg

SEQ ID NO: 3698 - DNA, 24 bp, Artificial Sequence
  Description of Artificial Sequence: Synthetic primer
aacctcatttttaggccaaaataa

SEQ ID NO: 3699 - DNA, 24 bp, Artificial Sequence
  Description of Artificial Sequence: Synthetic primer
aatgagcactgagccataaaaggt

SEQ ID NO: 3700 - DNA, 24 bp, Artificial Sequence
  Description of Artificial Sequence: Synthetic primer
aagttctaaatctcaggaataaaa

SEQ ID NO: 3701 - DNA, 19 bp, Artificial Sequence
  Description of Artificial Sequence: Synthetic primer
atggttcaactgttctggc

SEQ ID NO: 3702 - DNA, 24 bp, Artificial Sequence
  Description of Artificial Sequence: Synthetic primer
tagaaatcaactttccttctatgc

SEQ ID NO: 3703 - DNA, 21 bp, Artificial Sequence
  Description of Artificial Sequence: Synthetic primer
ggataggatttgtgagattta

SEQ ID NO: 3704 - DNA, 22 bp, Artificial Sequence
  Description of Artificial Sequence: Synthetic primer
ctgaaatgtatgtaccctttcc

SEQ ID NO: 3705 - DNA, 19 bp, Artificial Sequence
  Description of Artificial Sequence: Synthetic primer
aagaaggcaggtacaggag

SEQ ID NO: 3706 - DNA, 26 bp, Artificial Sequence
  Description of Artificial Sequence: Synthetic primer
cctgccttctttctagtccagaatac

SEQ ID NO: 3707 - DNA, 19 bp, Artificial Sequence
  Description of Artificial Sequence: Synthetic primer
cagtagcaggatggttatt

SEQ ID NO: 3708 - DNA, 25 bp, Artificial Sequence
  Description of Artificial Sequence: Synthetic primer
aattttacttttccaaaataagtca

SEQ ID NO: 3709 - DNA, 17 bp, Artificial Sequence
  Description of Artificial Sequence: Synthetic primer
accatggtgtggttttg

SEQ ID NO: 3710 - DNA, 26 bp, Artificial Sequence
  Description of Artificial Sequence: Synthetic primer
ctctattctgactgcctgcacccctc

SEQ ID NO: 3711 - DNA, 18 bp, Artificial Sequence
  Description of Artificial Sequence: Synthetic primer
cctgtaaccaccctaatc

SEQ ID NO: 3712 - DNA, 23 bp, Artificial Sequence
  Description of Artificial Sequence: Synthetic primer
agtaactgaaggaggtggcattt

SEQ ID NO: 3713 - DNA, 22 bp, Artificial Sequence
  Description of Artificial Sequence: Synthetic primer
ctttgttcaatgcctcctttat

SEQ ID NO: 3714 - DNA, 17 bp, Artificial Sequence
  Description of Artificial Sequence: Synthetic primer
cccagggctaggcataa

SEQ ID NO: 3715 - DNA, 23 bp, Artificial Sequence
  Description of Artificial Sequence: Synthetic primer
cctgggtatgttatttctcttac

SEQ ID NO: 3716 - DNA, 23 bp, Artificial Sequence
  Description of Artificial Sequence: Synthetic primer
tcttcccttggaagagcctcccc

SEQ ID NO: 3717 - DNA, 17 bp, Artificial Sequence
  Description of Artificial Sequence: Synthetic primer
gctcggttagtaagtgg

SEQ ID NO: 3718 - DNA, 19 bp, Artificial Sequence
  Description of Artificial Sequence: Synthetic primer
gcagtttacctccttctac

SEQ ID NO: 3719 - DNA, 24 bp, Artificial Sequence
  Description of Artificial Sequence: Synthetic primer
agggtgggcctgggcctgagggaa

SEQ ID NO: 3720 - DNA, 22 bp, Artificial Sequence
  Description of Artificial Sequence: Synthetic primer
tcagcaggaacaagtctagggg

SEQ ID NO: 3721 - DNA, 22 bp, Artificial Sequence
  Description of Artificial Sequence: Synthetic primer
agacttgttcctgctgacagag

SEQ ID NO: 3722 - DNA, 19 bp, Artificial Sequence
  Description of Artificial Sequence: Synthetic primer
gtgaagatcaaaatccctc

SEQ ID NO: 3723 - DNA, 18 bp, Artificial Sequence
  Description of Artificial Sequence: Synthetic primer
gcctgagggtgcccagtc

SEQ ID NO: 3724 - DNA, 18 bp, Artificial Sequence
  Description of Artificial Sequence: Synthetic primer
aagcctcctatgcttgcc

SEQ ID NO: 3725 - DNA, 24 bp, Artificial Sequence
  Description of Artificial Sequence: Synthetic primer
ggcaagcataggaggctttatgga

SEQ ID NO: 3726 - DNA, 23 bp, Artificial Sequence
  Description of Artificial Sequence: Synthetic primer
tcaccaggccctcactaataccc

SEQ ID NO: 3727 - DNA, 18 bp, Artificial Sequence
  Description of Artificial Sequence: Synthetic primer
ctcctttgcacacgggct

SEQ ID NO: 3728 - DNA, 22 bp, Artificial Sequence
  Description of Artificial Sequence: Synthetic primer
ggatgggtttatattgggaaaa

SEQ ID NO: 3729 - DNA, 19 bp, Artificial Sequence
  Description of Artificial Sequence: Synthetic primer
agggtgcggtgttggcagc

SEQ ID NO: 3730 - DNA, 20 bp, Artificial Sequence
  Description of Artificial Sequence: Synthetic primer
aacaccgcacccttcccacc

SEQ ID NO: 3731 - DNA, 20 bp, Artificial Sequence
  Description of Artificial Sequence: Synthetic primer
atgacataaatccacttagc

SEQ ID NO: 3732 - DNA, 21 bp, Artificial Sequence
  Description of Artificial Sequence: Synthetic primer
gactccacccttctcccagag

SEQ ID NO: 3733 - DNA, 18 bp, Artificial Sequence
  Description of Artificial Sequence: Synthetic primer
ggtggagccgccagctgt

SEQ ID NO: 3734 - DNA, 19 bp, Artificial Sequence
  Description of Artificial Sequence: Synthetic primer
tctggcgagccctcttacc

SEQ ID NO: 3735 - DNA, 26 bp, Artificial Sequence
  Description of Artificial Sequence: Synthetic primer
ttaaagcttgccacctgtttttgttg

SEQ ID NO: 3736 - DNA, 19 bp, Artificial Sequence
  Description of Artificial Sequence: Synthetic primer
gaaacgcaactaaaagagc

SEQ ID NO: 3737 - DNA, 22 bp, Artificial Sequence
  Description of Artificial Sequence: Synthetic primer
tcagttaaatacattcctctct

SEQ ID NO: 3738 - DNA, 23 bp, Artificial Sequence
  Description of Artificial Sequence: Synthetic primer
tttgacagaaagtaacagcttca

SEQ ID NO: 3739 - DNA, 25 bp, Artificial Sequence
  Description of Artificial Sequence: Synthetic primer
agccctattttgaaatttccctttt

SEQ ID NO: 3740 - DNA, 26 bp, Artificial Sequence
  Description of Artificial Sequence: Synthetic primer
gaaatttcaaaatagggcttcagcag

SEQ ID NO: 3741 - DNA, 19 bp, Artificial Sequence
  Description of Artificial Sequence: Synthetic primer
cctggaagtgagtcccacc

SEQ ID NO: 3742 - DNA, 18 bp, Artificial Sequence
  Description of Artificial Sequence: Synthetic primer
ggcccagagcaggccgat

SEQ ID NO: 3743 - DNA, 22 bp, Artificial Sequence
  Description of Artificial Sequence: Synthetic primer
gagacagaaacagccaggatca

SEQ ID NO: 3744 - DNA, 25 bp, Artificial Sequence
  Description of Artificial Sequence: Synthetic primer
gcctggtggccctgcctgttgcctt

SEQ ID NO: 3745 - DNA, 27 bp, Artificial Sequence
  Description of Artificial Sequence: Synthetic primer
ttctctccttctataatggcttatttt

SEQ ID NO: 3746 - DNA, 27 bp, Artificial Sequence
  Description of Artificial Sequence: Synthetic primer
gaatatctccttggccttcctatctaa

SEQ ID NO: 3747 - DNA, 18 bp, Artificial Sequence
  Description of Artificial Sequence: Synthetic primer
tcagcgggagagcaggga

SEQ ID NO: 3748 - DNA, 17 bp, Artificial Sequence
  Description of Artificial Sequence: Synthetic primer
ccctgctgcactcactc

SEQ ID NO: 3749 - DNA, 20 bp, Artificial Sequence
  Description of Artificial Sequence: Synthetic primer
tcaggcagctggtggtcctt

SEQ ID NO: 3750 - DNA, 19 bp, Artificial Sequence
  Description of Artificial Sequence: Synthetic primer
gctattccccctaatccta

SEQ ID NO: 3751 - DNA, 22 bp, Artificial Sequence
  Description of Artificial Sequence: Synthetic primer
cagaaatagctacaggagaaga

SEQ ID NO: 3752 - DNA, 17 bp, Artificial Sequence
  Description of Artificial Sequence: Synthetic primer
tttctctttctcctccc

SEQ ID NO: 3753 - DNA, 23 bp, Artificial Sequence
  Description of Artificial Sequence: Synthetic primer
tttaggagaagaaaaagaagaga

SEQ ID NO: 3754 - DNA, 26 bp, Artificial Sequence
  Description of Artificial Sequence: Synthetic primer
ttattttcttcttgagtacactctta

SEQ ID NO: 3755 - DNA, 26 bp, Artificial Sequence
  Description of Artificial Sequence: Synthetic primer
agaagaaaataacattttcctgtata

SEQ ID NO: 3756 - DNA, 22 bp, Artificial Sequence
  Description of Artificial Sequence: Synthetic primer
tcaccccttcattttaatttta

SEQ ID NO: 3757 - DNA, 24 bp, Artificial Sequence
  Description of Artificial Sequence: Synthetic primer
gaagaaggcatctctggataatga

SEQ ID NO: 3758 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcmctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 3759 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  modified_base (89)..(89): a, c, t, g, unknown or other
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (226)..(226): a, c, t, g, unknown or other
  modified_base (243)..(243): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctacttncaagttctttccccaaacttttctcacctatgtttncctatggggctntngaytcagnttcatgngcaatgtgttcctataaagaagaaggagtgtagggycaccttcngcttatgttttagctctagaggatgagngaagagccaacgtgtgncagtttgaggatggatgtacagtgagtagtgaggggctttttccaccttgaayrcatgagngctcttgagnccctcccactgnanttcagagtcaccagatntgtgcatgatatctctgc

SEQ ID NO: 3760 - DNA, 149 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (51)..(51): a, c, t, g, unknown or other
  modified_base (71)..(71): a, c, t, g, unknown or other
  modified_base (97)..(97): a, c, t, g, unknown or other
  modified_base (106)..(106): a, c, t, g, unknown or other
  modified_base (117)..(117): a, c, t, g, unknown or other
gatgaagnynacgttatttgctccactttccactgactggaatcytcttanctcatctctgtagatgcctnaatrtcaccaacttctttcttcaagncagcctccncatcatcatcntctccctcacttccagagggctgctgatcctt

SEQ ID NO: 3761 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnayattcacccaaagcttgagagctagagcnagnagagacttgcnaktcngtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaanaccttttatggctcagtgctcattc

SEQ ID NO: 3762 - DNA, 785 bp, Artificial Sequence
  Description of Artificial Sequence: Synthetic polynucleotide
  modified_base (17)..(17): a, c, t, g, unknown or other
  modified_base (20)..(20): a, c, t, g, unknown or other
  modified_base (116)..(116): a, c, t, g, unknown or other
  modified_base (133)..(133): a, c, t, g, unknown or other
  modified_base (137)..(137): a, c, t, g, unknown or other
  modified_base (156)..(156): a, c, t, g, unknown or other
  modified_base (173)..(173): a, c, t, g, unknown or other
  modified_base (212)..(212): a, c, t, g, unknown or other
  modified_base (247)..(247): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (319)..(319): a, c, t, g, unknown or other
  modified_base (332)..(332): a, c, t, g, unknown or other
  modified_base (349)..(349): a, c, t, g, unknown or other
  modified_base (383)..(383): a, c, t, g, unknown or other
  modified_base (420)..(420): a, c, t, g, unknown or other
  modified_base (423)..(423): a, c, t, g, unknown or other
  modified_base (434)..(474): a, c, t, g, unknown or other
  modified_base (522)..(522): a, c, t, g, unknown or other
  modified_base (569)..(569): a, c, t, g, unknown or other
  modified_base (586)..(648): a, c, t, g, unknown or other
  modified_base (650)..(658): a, c, t, g, unknown or other
  modified_base (682)..(682): a, c, t, g, unknown or other
  modified_base (702)..(702): a, c, t, g, unknown or other
  modified_base (705)..(705): a, c, t, g, unknown or other
  modified_base (718)..(718): a, c, t, g, unknown or other
  modified_base (721)..(721): a, c, t, g, unknown or other
  modified_base (770)..(770): a, c, t, g, unknown or other
  modified_base (775)..(775): a, c, t, g, unknown or other
atatttttctttgcctncantgaattccctctcttggcaatgccttataagttaccatgcaaaaaaatataaatgtatctcatttatctgttctcccctaccccccacaacsctanctacctctcacaggacnaagnattggaaaggccttagtgnagccaccacctaaccanagaaatgatccaaactcacatactactacttctttattnttcagtaaagttctccaaactaaaatgaaatatgnagtttgaaaatangtagtaaaaatacagcttttnaaatatatcctctrtgctntttcatagccacttcacantgaccctacttcnccatttataactcaccnagttagttattagtaaacaactcttaatcaaaantaaaaatgaagggctatggaactgttctcatatcccnttnagtgtcttaannnnnnnnnnnnnnnnnnnnnnnnnnnnnnnnnnnnnnnnnagcgcagtgtttaatgaacttgcctaaagycacatcagaaccaccagnaagcacaatttcattgtattttgtgtgaatgccctccccagcacaangaacggagctgtacaannnnnnnnnnnnnnnnnnnnnnnnnnnnnnnnnnnnnnnnnnnnnnnnnnnnnnnnnnnnnnnrnnnnnnnnnaaaacctccaaaaaacactgcttncatcactgaaattaaagamnaanaatacaatataantanaataaaatgagaattccttgttatataataagccagtttatcagctttntttgnaaggaagaaa

SEQ ID NO: 3763 - DNA, 167 bp, Artificial Sequence
  Description of Artificial Sequence: Synthetic polynucleotide
  modified_base (64)..(64): a, c, t, g, unknown or other
  modified_base (88)..(88): a, c, t, g, unknown or other
  modified_base (98)..(98): a, c, t, g, unknown or other
agaatttattgccatgtacacttacsagagttctgagcaaggagatttaacctttcagcaaggngatgtgattttggttaccaagaangatggtgacnggtggacaggaacagtgggcgacaaggccggagtcttcccttctaactatgtgaggcttaaagattcag

SEQ ID NO: 3764 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacrtaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 3765 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatacnttttcctaaattccncyaataaccatcctgctactgctttgtgtgaaattctccaaaaaaaattttacttttccaaaataagtcangctccctctcttaggatncaaaaccacaccatggtcccagccaatctttcagcctg

SEQ ID NO: 3766 - DNA, 272 bp, Artificial Sequence
  Description of Artificial Sequence: Synthetic polynucleotide
  modified_base (33)..(33): a, c, t, g, unknown or other
  modified_base (103)..(103): a, c, t, g, unknown or other
  modified_base (114)..(114): a, c, t, g, unknown or other
  modified_base (122)..(122): a, c, t, g, unknown or other
  modified_base (134)..(134): a, c, t, g, unknown or other
  modified_base (159)..(159): a, c, t, g, unknown or other
  modified_base (205)..(205): a, c, t, g, unknown or other
  modified_base (259)..(259): a, c, t, g, unknown or other
gggacacaagtgcaggttcagggcaaggtgtgngagcacactcagtccctggcctcggagtctctctggatggcttcttgcctagggtgactgacagaggganggatgatatgnaaaggcanctgttctcctcngacctaaccccaattcttactccangggttcatgacagccyattctgctggagactgtgtcttaaaacttnctcccctagtttctctcaagtacccctcgtgagctgtgatttcactgggctttnaactcttaggcca

SEQ ID NO: 3767 - DNA, 575 bp, Artificial Sequence
  Description of Artificial Sequence: Synthetic polynucleotide
  modified_base (10)..(10): a, c, t, g, unknown or other
  modified_base (61)..(61): a, c, t, g, unknown or other
  modified_base (82)..(82): a, c, t, g, unknown or other
  modified_base (98)..(98): a, c, t, g, unknown or other
  modified_base (101)..(101): a, c, t, g, unknown or other
  modified_base (107)..(107): a, c, t, g, unknown or other
  modified_base (114)..(114): a, c, t, g, unknown or other
  modified_base (118)..(118): a, c, t, g, unknown or other
  modified_base (121)..(121): a, c, t, g, unknown or other
  modified_base (151)..(151): a, c, t, g, unknown or other
  modified_base (155)..(155): a, c, t, g, unknown or other
  modified_base (171)..(171): a, c, t, g, unknown or other
  modified_base (173)..(173): a, c, t, g, unknown or other
  modified_base (175)..(175): a, c, t, g, unknown or other
  modified_base (184)..(184): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (210)..(210): a, c, t, g, unknown or other
  modified_base (212)..(212): a, c, t, g, unknown or other
  modified_base (231)..(231): a, c, t, g, unknown or other
  modified_base (250)..(250): a, c, t, g, unknown or other
  modified_base (259)..(259): a, c, t, g, unknown or other
  modified_base (267)..(267): a, c, t, g, unknown or other
  modified_base (272)..(272): a, c, t, g, unknown or other
  modified_base (281)..(281): a, c, t, g, unknown or other
  modified_base (283)..(283): a, c, t, g, unknown or other
  modified_base (337)..(337): a, c, t, g, unknown or other
  modified_base (339)..(339): a, c, t, g, unknown or other
  modified_base (362)..(362): a, c, t, g, unknown or other
  modified_base (367)..(367): a, c, t, g, unknown or other
  modified_base (395)..(395): a, c, t, g, unknown or other
  modified_base (408)..(408): a, c, t, g, unknown or other
  modified_base (423)..(423): a, c, t, g, unknown or other
  modified_base (434)..(434): a, c, t, g, unknown or other
  modified_base (443)..(443): a, c, t, g, unknown or other
  modified_base (478)..(478): a, c, t, g, unknown or other
  modified_base (498)..(498): a, c, t, g, unknown or other
  modified_base (500)..(500): a, c, t, g, unknown or other
  modified_base (502)..(502): a, c, t, g, unknown or other
  modified_base (505)..(505): a, c, t, g, unknown or other
  modified_base (509)..(509): a, c, t, g, unknown or other
  modified_base (515)..(515): a, c, t, g, unknown or other
  modified_base (520)..(520): a, c, t, g, unknown or other
  modified_base (527)..(527): a, c, t, g, unknown or other
  modified_base (531)..(531): a, c, t, g, unknown or other
  modified_base (533)..(533): a, c, t, g, unknown or other
  modified_base (567)..(567): a, c, t, g, unknown or other
ctcgtggtgntggtgaggtgtgtctggctgtccatcagcctctctctccygggatcagtcngccagctctagtggcagcgcngggcaaagcagctccnccnactcanttggccngggncangtccttgtcgggacaagcgacgctgttagngacnttgtgagagaaagggncntnrggctaggncggcngttcanccctgngcagccctngnagctctgggtgggtgaggnaagagggggccttgcaggnggggcggcnagggaacnaaaanaatccctcngncggcaaggaggaggacaggagggtatcccaggaccgtgggcccagggccctgangnctgggagcacaaactgtcctgancaggncgatgtggtggaagcttgggagctcagnagcctggggaagncctggagcgtcggangaatggaggcncccagagancccgaagtctgggcaggggatggaaacctctggcntccccactcawcagcagggngncncmncggnggtccngtgcntggcctnrscngngatggcgggaggctcttggaggccggcggaaggncagcgcgg

SEQ ID NO: 3768 - DNA, 263 bp, Artificial Sequence
  Description of Artificial Sequence: Synthetic polynucleotide
  modified_base (51)..(51): a, c, t, g, unknown or other
  modified_base (59)..(59): a, c, t, g, unknown or other
  modified_base (84)..(84): a, c, t, g, unknown or other
  modified_base (87)..(87): a, c, t, g, unknown or other
  modified_base (215)..(215): a, c, t, g, unknown or other
  modified_base (261)..(261): a, c, t, g, unknown or other
ctatttctaccttctaatgagaattttaaaaactataaacatgattttttnaaaaaaanattgagtttccaaaaagaaaggaangangattaatccagaaactccacatcttcctggattggagggtaccctatcrttcaaaaattcttccagagtatcatawgtttcagayggattcaagcagaatattttttcaaagatcagtaagcggtgcncttagaagagaaacagcctctctrcatctaagactgtgagtattanaa

SEQ ID NO: 3769 - DNA, 99 bp, Artificial Sequence
  Description of Artificial Sequence: Synthetic oligonucleotide
  misc_feature (30)..(31): This region may encompass 'tg' or 'cc'
  modified_base (72)..(72): a, c, t, g, unknown or other
gctgcattctacctcccaaattaagatacysgagaagccaccttgcccagcayaagtgcatcactsaagtcnaagtcttgaacgtggccttggycttga

SEQ ID NO: 3770 - DNA, 344 bp, Artificial Sequence
  Description of Artificial Sequence: Synthetic polynucleotide
  modified_base (10)..(39): a, c, t, g, unknown or other
  modified_base (41)..(46): a, c, t, g, unknown or other
  modified_base (52)..(52): a, c, t, g, unknown or other
  modified_base (64)..(64): a, c, t, g, unknown or other
  modified_base (66)..(66): a, c, t, g, unknown or other
  modified_base (79)..(79): a, c, t, g, unknown or other
  modified_base (109)..(109): a, c, t, g, unknown or other
  modified_base (144)..(144): a, c, t, g, unknown or other
  modified_base (172)..(172): a, c, t, g, unknown or other
  modified_base (200)..(200): a, c, t, g, unknown or other
  modified_base (230)..(230): a, c, t, g, unknown or other
  modified_base (242)..(242): a, c, t, g, unknown or other
  misc_feature (252)..(253): This region may encompass 'ag' or 'ga'
  modified_base (279)..(279): a, c, t, g, unknown or other
ataatgctgnnnnnnnnnnnnnnnnnnnnnnnnnnnnnnynnnnnngcaaantataaatataananacatatttacttntacttgtgcaaataattctataggcctgantgaaagggaatgttccacctttctacctttttttnaatgacaaatttctgataaaattccttnttacctaatgaatgacttcagtttcaanatatgctaaatgcattcagtttccagtagnctgggcacacantgtatgctarracttggtgaacttgaggactgaaagntttcttggcctgcttgtctggaaagtgcagtggttccttgcagaccttttgtcttcattattttc

SEQ ID NO: 3771 - DNA, 599 bp, Artificial Sequence
  Description of Artificial Sequence: Synthetic polynucleotide
  modified_base (3)..(3): a, c, t, g, unknown or other
  modified_base (75)..(75): a, c, t, g, unknown or other
  modified_base (80)..(80): a, c, t, g, unknown or other
  modified_base (143)..(143): a, c, t, g, unknown or other
  modified_base (174)..(174): a, c, t, g, unknown or other
  modified_base (188)..(188): a, c, t, g, unknown or other
  modified_base (195)..(195): a, c, t, g, unknown or other
  modified_base (200)..(200): a, c, t, g, unknown or other
  modified_base (211)..(211): a, c, t, g, unknown or other
  modified_base (216)..(216): a, c, t, g, unknown or other
  modified_base (269)..(269): a, c, t, g, unknown or other
  modified_base (496)..(496): a, c, t, g, unknown or other
  modified_base (507)..(507): a, c, t, g, unknown or other
  modified_base (509)..(509): a, c, t, g, unknown or other
  modified_base (548)..(548): a, c, t, g, unknown or other
  modified_base (593)..(593): a, c, t, g, unknown or other
ggnacttctgaggggtgaagaacttgaagggagaataatataacttattagtcaaataaatgaaaatatcataantgtgnatatgttcttgtgagtgggggtagctcagcagtgtgtgttcatccccagaaaagagaaaatcntgtctgctgtggaaagaagacatagyttttnacatatgtggttantattaangacanctgagcctggntactngatcatgttataatgctaaagggaagattcaatagaagaaagaatgtcatagnaaaaacaaaaaaattaagcatcaaagatttaaatgaaatgactttgaatattactagtaatgaacatgccaagaaaaatcaattactataaccagaagaataattcatgactgcccatgggattcatgctgagaagatatacaatttccatttaatttccatttactgaaaattaaattaaatttagtgagggctcatcactaccctcataaaatggttcagagagnaagcgaagaananagtgtgagcttacagcaagtggagaccatctcttctccnaatgtcccacagctccacagcccacctgtccaggttctatcaagnaatttt

SEQ ID NO: 3772 - DNA, 151 bp, Artificial Sequence
  Description of Artificial Sequence: Synthetic polynucleotide
  modified_base (18)..(18): a, c, t, g, unknown or other
  modified_base (42)..(42): a, c, t, g, unknown or other
  modified_base (45)..(45): a, c, t, g, unknown or other
  modified_base (83)..(83): a, c, t, g, unknown or other
  modified_base (85)..(85): a, c, t, g, unknown or other
  modified_base (118)..(118): a, c, t, g, unknown or other
  modified_base (126)..(126): a, c, t, g, unknown or other
  modified_base (130)..(130): a, c, t, g, unknown or other
  modified_base (147)..(147): a, c, t, g, unknown or other
acacctgggaggttctcnaggacactctgaaggaactcaggntcntgcatcacgycgtaatcatcctcctccttggctggctnrnawgtgtccatggctgagctggcatcaatgtctnctgattcngccnggccaaactctgctccntgca

SEQ ID NO: 3773 - DNA, 1290 bp, Artificial Sequence
  Description of Artificial Sequence: Synthetic polynucleotide
  modified_base (173)..(173): a, c, t, g, unknown or other
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  modified_base (623)..(623): a, c, t, g, unknown or other
  modified_base (833)..(833): a, c, t, g, unknown or other
  modified_base (862)..(862): a, c, t, g, unknown or other
  modified_base (1099)..(1099): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaarttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 3774 - DNA, 653 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (171)..(171): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (348)..(348): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  modified_base (510)..(510): a, c, t, g, unknown or other
  modified_base (574)..(574): a, c, t, g, unknown or other
  modified_base (577)..(577): a, c, t, g, unknown or other
  modified_base (615)..(615): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatnaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgntttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagaccctnatcatatctagcttttaacctaccagttatgcacctagcrtcaaaaacaccatttcctccgagnttnacaagcctactgaaatcaccatagttctttagtaagcntcagaagcctggagtatggatgtatatttttctcctgt

SEQ ID NO: 3775 - DNA, 600 bp, Artificial Sequence
  Description of Artificial Sequence: Synthetic polynucleotide
  modified_base (170)..(170): a, c, t, g, unknown or other
  modified_base (313)..(313): a, c, t, g, unknown or other
  modified_base (508)..(508): a, c, t, g, unknown or other
gactgacagtggcataggcattgaccacaaacttgtggacaccataggtgacagggccaattacccataacagcattgtggatgatgagaggatgaagtccactgagtacatcagcacaaaggaattcaccagcatcaggatggtcttggtggccattttcactagagangtccttaatataaggctgctgctgtgaaagtgctgggagtgcctctgatgcctggacaaaagaatgaccatgtatacacttgagagcagcgtgattcctatgaagaaggcatctctggataatgayagcataagaaatagcgncctgatgaggacattcattgggaaaaatgtgcaatatttgctgatattcaaaattatctgggtcattggaataacctacagtgtagattatcatgtcrctactgaaagacaaattgctaaaccaaaaaacgaataagcccaggatatcrtattttgtaaatttatgtttaaatctmaccaaccaggaggtgctgnggctgatggtaatggcctggarcatgctcaggaggcaggtggtgcagatggagaggcccctcatcaccttstgcaaatagaagaaagcttta

SEQ ID NO: 3776 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctarggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3777 - DNA, 690 bp, Artificial Sequence
  Description of Artificial Sequence: Synthetic polynucleotide
  modified_base (7)..(7): a, c, t, g, unknown or other
  modified_base (12)..(12): a, c, t, g, unknown or other
  modified_base (20)..(20): a, c, t, g, unknown or other
  modified_base (34)..(34): a, c, t, g, unknown or other
  modified_base (40)..(40): a, c, t, g, unknown or other
  modified_base (46)..(46): a, c, t, g, unknown or other
  modified_base (53)..(53): a, c, t, g, unknown or other
  modified_base (61)..(61): a, c, t, g, unknown or other
  modified_base (66)..(66): a, c, t, g, unknown or other
  modified_base (91)..(91): a, c, t, g, unknown or other
  modified_base (119)..(119): a, c, t, g, unknown or other
  modified_base (140)..(140): a, c, t, g, unknown or other
  modified_base (154)..(154): a, c, t, g, unknown or other
  modified_base (174)..(174): a, c, t, g, unknown or other
  modified_base (176)..(176): a, c, t, g, unknown or other
  modified_base (190)..(190): a, c, t, g, unknown or other
  modified_base (218)..(218): a, c, t, g, unknown or other
  modified_base (223)..(223): a, c, t, g, unknown or other
  modified_base (242)..(242): a, c, t, g, unknown or other
  modified_base (244)..(244): a, c, t, g, unknown or other
  modified_base (259)..(259): a, c, t, g, unknown or other
  modified_base (267)..(267): a, c, t, g, unknown or other
  modified_base (276)..(276): a, c, t, g, unknown or other
  modified_base (284)..(284): a, c, t, g, unknown or other
  modified_base (289)..(289): a, c, t, g, unknown or other
  modified_base (318)..(318): a, c, t, g, unknown or other
  modified_base (329)..(329): a, c, t, g, unknown or other
  modified_base (362)..(362): a, c, t, g, unknown or other
  modified_base (372)..(372): a, c, t, g, unknown or other
  modified_base (386)..(386): a, c, t, g, unknown or other
  modified_base (394)..(394): a, c, t, g, unknown or other
  modified_base (401)..(401): a, c, t, g, unknown or other
  modified_base (409)..(409): a, c, t, g, unknown or other
  modified_base (449)..(449): a, c, t, g, unknown or other
  modified_base (456)..(456): a, c, t, g, unknown or other
  modified_base (483)..(483): a, c, t, g, unknown or other
  modified_base (540)..(540): a, c, t, g, unknown or other
  modified_base (547)..(547): a, c, t, g, unknown or other
  modified_base (553)..(553): a, c, t, g, unknown or other
  modified_base (580)..(580): a, c, t, g, unknown or other
  modified_base (616)..(616): a, c, t, g, unknown or other
  modified_base (683)..(683): a, c, t, g, unknown or other
tgatgcnaacangcatcatntctggccactgaanccaggntcttangtttaancataaaangcttngtctcatgggctgcaaaccaccaanatagaactaagattgataagaaaaatanactgtttactcaaaacaggtntataccagcctacntatttataatgtcctattananggttgtacagttcntatcctcaataattcagtaggtatcycnctaanatctatttgaaatcccccnanaataacatttagcantagcttcntgatctctntagaatgntgtcnttatttttcttaaacatttgatatgttanaccacccaggnggaaaatagaacacagagtgtaggatacacacntactcaccanaaaaacaaccatantgtaacancaaaatntatttatnaattggtcaaggaaattgaatttaacatatgctgttatcntacaagnatttttaatgaaataacatyttgtatntatatagcacctttctactaaggagcaaaaatatggctcagayattattactcattntcacacnatcctngacaggtggataagtagyaacatttanaccaagttttaatcactgggaaacaaagacatgcanaaaragagcaaataaaccacaaatggtaacccagaaagttggcattttccaccccccaatgcccacngtggtcc

SEQ ID NO: 3778 - DNA, 176 bp, Artificial Sequence
  Description of Artificial Sequence: Synthetic polynucleotide
  modified_base (12)..(12): a, c, t, g, unknown or other
  modified_base (35)..(35): a, c, t, g, unknown or other
  modified_base (38)..(38): a, c, t, g, unknown or other
  modified_base (84)..(84): a, c, t, g, unknown or other
  modified_base (113)..(113): a, c, t, g, unknown or other
  modified_base (120)..(120): a, c, t, g, unknown or other
  modified_base (126)..(126): a, c, t, g, unknown or other
  modified_base (145)..(145): a, c, t, g, unknown or other
  modified_base (151)..(151): a, c, t, g, unknown or other
  modified_base (156)..(156): a, c, t, g, unknown or other
  modified_base (174)..(174): a, c, t, g, unknown or other
ggaagggaaaantcaatatcttacagtacagtttncantctaagaaatactacacattttatgttayaagcaaaattttatggnatagtttatgaaataaaattgaacctcanagttttnaatttntttgtacaataatgtttcntttagncactnccccatcctccttttaanta

SEQ ID NO: 3779 - DNA, 857 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (108)..(108): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (609)..(609): a, c, t, g, unknown or other
  modified_base (755)..(755): a, c, t, g, unknown or other
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaanttcagaggtataacttcaacattaacaggtgaaaagttctacaatgactngttgcactcyatcacattanaataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatyccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 3780 - DNA, 186 bp, Artificial Sequence
  Description of Artificial Sequence: Synthetic polynucleotide
  modified_base (37)..(37): a, c, t, g, unknown or other
  modified_base (48)..(48): a, c, t, g, unknown or other
  modified_base (59)..(59): a, c, t, g, unknown or other
  modified_base (73)..(73): a, c, t, g, unknown or other
  modified_base (127)..(127): a, c, t, g, unknown or other
  modified_base (142)..(142): a, c, t, g, unknown or other
  modified_base (163)..(163): a, c, t, g, unknown or other
  modified_base (184)..(184): a, c, t, g, unknown or other
caacaaggtcttccatccttcttataaatcttaagantgtgtttaagntttctttcacntttactctatcccntggaagttaattgggaataaaaagatttatcaattyagtcactataatttaagnccaggcatctgcttngaaatacaataaccacaattnatacttagagaaaattgtttnca

SEQ ID NO: 3781 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctyattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 3782 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttaygtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 3783 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcraccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 3784 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcyrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 3785 - DNA, 866 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (261)..(261): a, c, t, g, unknown or other
  modified_base (280)..(280): a, c, t, g, unknown or other
  modified_base (297)..(297): a, c, t, g, unknown or other
  modified_base (326)..(326): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  misc_feature (376)..(376): May or may not be present
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  modified_base (583)..(583): a, c, t, g, unknown or other
  modified_base (617)..(617): a, c, t, g, unknown or other
  modified_base (648)..(648): a, c, t, g, unknown or other
  modified_base (673)..(673): a, c, t, g, unknown or other
  modified_base (697)..(697): a, c, t, g, unknown or other
  modified_base (711)..(711): a, c, t, g, unknown or other
  modified_base (716)..(716): a, c, t, g, unknown or other
  modified_base (733)..(733): a, c, t, g, unknown or other
  modified_base (798)..(798): a, c, t, g, unknown or other
  modified_base (800)..(800): a, c, t, g, unknown or other
  modified_base (814)..(814): a, c, t, g, unknown or other
  modified_base (828)..(828): a, c, t, g, unknown or other
  modified_base (837)..(837): a, c, t, g, unknown or other
  modified_base (854)..(854): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactngangtcnctaataaagatacatttagttgncccagcaaagaatgcttaggattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaagnarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 3786 - DNA, 124 bp, Artificial Sequence
  Description of Artificial Sequence: Synthetic polynucleotide
  modified_base (3)..(3): a, c, t, g, unknown or other
  modified_base (11)..(11): a, c, t, g, unknown or other
  modified_base (13)..(13): a, c, t, g, unknown or other
  modified_base (27)..(27): a, c, t, g, unknown or other
  modified_base (44)..(44): a, c, t, g, unknown or other
  modified_base (67)..(67): a, c, t, g, unknown or other
  misc_feature (72)..(73): This region may encompass 'ca' or 'tg'
  modified_base (110)..(110): a, c, t, g, unknown or other
ttnattttcantnatgtttggacatgnggaaggaagagacatantctagaattctatcagaagattnacatyrcttgagcaactgctcagtcatacctctgagaayagtnattttaaataaaat

SEQ ID NO: 3787 - DNA, 175 bp, Artificial Sequence
  Description of Artificial Sequence: Synthetic polynucleotide
  modified_base (104)..(162): a, c, t, g, unknown or other
tgtcccagaaatgtcattacatttgtgtatgtgagcgccaatagygttttattctgccctgagtctcatgtttcattcctccattattttgaaaatcaagtacnnnnnnnnnnnnnnnnnnnnnnnnnnnnnnnnnnnnnnnnnnnnnnnnnnnnnnnnnnngtaataacacagt

SEQ ID NO: 3788 - DNA, 1141 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  modified_base (194)..(194): a, c, t, g, unknown or other
  modified_base (211)..(211): a, c, t, g, unknown or other
  modified_base (231)..(231): a, c, t, g, unknown or other
  modified_base (254)..(254): a, c, t, g, unknown or other
  modified_base (287)..(287): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (331)..(331): a, c, t, g, unknown or other
  modified_base (356)..(356): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
  modified_base (394)..(394): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (443)..(443): a, c, t, g, unknown or other
  modified_base (458)..(458): a, c, t, g, unknown or other
  modified_base (476)..(476): a, c, t, g, unknown or other
  modified_base (488)..(488): a, c, t, g, unknown or other
  modified_base (498)..(498): a, c, t, g, unknown or other
  modified_base (512)..(512): a, c, t, g, unknown or other
  modified_base (525)..(525): a, c, t, g, unknown or other
  modified_base (534)..(534): a, c, t, g, unknown or other
  modified_base (536)..(536): a, c, t, g, unknown or other
  modified_base (569)..(569): a, c, t, g, unknown or other
  modified_base (636)..(636): a, c, t, g, unknown or other
  modified_base (640)..(640): a, c, t, g, unknown or other
  modified_base (654)..(654): a, c, t, g, unknown or other
  modified_base (656)..(656): a, c, t, g, unknown or other
  modified_base (667)..(667): a, c, t, g, unknown or other
  modified_base (669)..(669): a, c, t, g, unknown or other
  modified_base (676)..(676): a, c, t, g, unknown or other
  modified_base (719)..(756): a, c, t, g, unknown or other
  modified_base (758)..(822): a, c, t, g, unknown or other
  modified_base (844)..(844): a, c, t, g, unknown or other
  modified_base (873)..(873): a, c, t, g, unknown or other
  modified_base (883)..(883): a, c, t, g, unknown or other
  modified_base (887)..(887): a, c, t, g, unknown or other
  modified_base (892)..(892): a, c, t, g, unknown or other
  modified_base (894)..(894): a, c, t, g, unknown or other
  modified_base (923)..(923): a, c, t, g, unknown or other
  modified_base (932)..(932): a, c, t, g, unknown or other
  modified_base (938)..(938): a, c, t, g, unknown or other
  modified_base (940)..(940): a, c, t, g, unknown or other
  modified_base (954)..(954): a, c, t, g, unknown or other
  modified_base (973)..(973): a, c, t, g, unknown or other
  modified_base (978)..(978): a, c, t, g, unknown or other
  modified_base (986)..(986): a, c, t, g, unknown or other
  modified_base (1000)..(1000): a, c, t, g, unknown or other
  modified_base (1010)..(1094): a, c, t, g, unknown or other
  modified_base (1096)..(1114): a, c, t, g, unknown or other
  modified_base (1135)..(1135): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttantattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcntccactaaccagaagcatgtcccagctctcttctgtgtcccaccattagaaaatcaaaagctgactntagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaayatacaccnttgatcatantgtntctcnancaaaagcttcaatggtcaagtactgaacnttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 3789 - DNA, 145 bp, Artificial Sequence
  Description of Artificial Sequence: Synthetic polynucleotide
  modified_base (2)..(2): a, c, t, g, unknown or other
  modified_base (10)..(10): a, c, t, g, unknown or other
  modified_base (17)..(17): a, c, t, g, unknown or other
  modified_base (41)..(41): a, c, t, g, unknown or other
  modified_base (44)..(44): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (91)..(91): a, c, t, g, unknown or other
  modified_base (96)..(96): a, c, t, g, unknown or other
  modified_base (128)..(128): a, c, t, g, unknown or other
  modified_base (133)..(133): a, c, t, g, unknown or other
gngccgagcncgcttgnmcagcacatactgagccttgcctntgngcttcccgccgccaggctgagnagnctgctgggcagngccgccatgntgtgngcaarctgagaggaaagagaaacgtttctccnctgcngttggcgtcctc

SEQ ID NO: 3790 - DNA, 346 bp, Artificial Sequence
  Description of Artificial Sequence: Synthetic polynucleotide
  modified_base (9)..(9): a, c, t, g, unknown or other
  modified_base (16)..(16): a, c, t, g, unknown or other
  modified_base (38)..(38): a, c, t, g, unknown or other
  modified_base (40)..(40): a, c, t, g, unknown or other
  modified_base (49)..(49): a, c, t, g, unknown or other
  modified_base (53)..(53): a, c, t, g, unknown or other
  modified_base (59)..(59): a, c, t, g, unknown or other
  modified_base (100)..(100): a, c, t, g, unknown or other
  modified_base (119)..(119): a, c, t, g, unknown or other
  modified_base (135)..(135): a, c, t, g, unknown or other
  modified_base (141)..(141): a, c, t, g, unknown or other
  modified_base (171)..(171): a, c, t, g, unknown or other
  modified_base (181)..(181): a, c, t, g, unknown or other
  modified_base (200)..(200): a, c, t, g, unknown or other
  modified_base (213)..(213): a, c, t, g, unknown or other
  modified_base (222)..(222): a, c, t, g, unknown or other
  modified_base (233)..(233): a, c, t, g, unknown or other
  modified_base (235)..(235): a, c, t, g, unknown or other
  modified_base (239)..(239): a, c, t, g, unknown or other
  modified_base (267)..(267): a, c, t, g, unknown or other
  modified_base (278)..(278): a, c, t, g, unknown or other
  modified_base (283)..(283): a, c, t, g, unknown or other
  modified_base (289)..(289): a, c, t, g, unknown or other
  modified_base (315)..(315): a, c, t, g, unknown or other
  modified_base (332)..(332): a, c, t, g, unknown or other
  modified_base (341)..(341): a, c, t, g, unknown or other
atgcttcanattcacntacccacaaactagtggatgananattttggcnattngaagantttattataggagtatgtagattttccatagagtgctgttntgtgayttgaattttagtnggccctgcctctgacnttgtcngtgrtttatcctggttccaggaaataagantagccttttnctcatgatagtctttggtngtttttaaaacanttgtttaantcaacagatgnancatntgcctgacwctgctctayaccagtgaanaatttacactntaatngggggnggtaactataaagatgataaacatancatcttaattggagtgngtatgaagntggtt

SEQ ID NO: 3791 - DNA, 174 bp, Artificial Sequence
  Description of Artificial Sequence: Synthetic polynucleotide
  modified_base (24)..(24): a, c, t, g, unknown or other
  modified_base (29)..(29): a, c, t, g, unknown or other
  modified_base (51)..(51): a, c, t, g, unknown or other
  modified_base (85)..(85): a, c, t, g, unknown or other
  modified_base (103)..(103): a, c, t, g, unknown or other
  modified_base (107)..(107): a, c, t, g, unknown or other
  modified_base (111)..(111): a, c, t, g, unknown or other
  modified_base (124)..(124): a, c, t, g, unknown or other
  modified_base (126)..(126): a, c, t, g, unknown or other
  modified_base (129)..(129): a, c, t, g, unknown or other
  modified_base (135)..(135): a, c, t, g, unknown or other
aaagattatgatgcactggcctgntctangacttcactgcattcatcagcncaggaracaaagacatgcacttttttcataattnttttagtaataattgacnattngagnaaatgaatggcanrnaanaattangggcagacaagatggtcagcaaatcaaactgggaaatgc

SEQ ID NO: 3792 - DNA, 175 bp, Artificial Sequence
  Description of Artificial Sequence: Synthetic polynucleotide
  modified_base (14)..(14): a, c, t, g, unknown or other
  modified_base (112)..(112): a, c, t, g, unknown or other
tttcatatccattnatggaaaataataatgtggggatgattcttaaaagggattctggaagtggyttcttcaattaaatatattcaaaactcattcccgcttactacacaantcaaagaggaattgaaaatgtgtgtgattcccactaaattattttcctttcatatggcttgat

SEQ ID NO: 3793 - DNA, 1351 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  misc_feature (1151)..(1152): This region may encompass 'ta' or 'cg'
  modified_base (1250)..(1288): a, c, t, g, unknown or other
  modified_base (1333)..(1333): a, c, t, g, unknown or other
  modified_base (1337)..(1337): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttayrgggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 3794 - DNA, 148 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (22)..(22): a, c, t, g, unknown or other
  modified_base (35)..(35): a, c, t, g, unknown or other
  modified_base (37)..(37): a, c, t, g, unknown or other
  modified_base (43)..(43): a, c, t, g, unknown or other
  modified_base (47)..(47): a, c, t, g, unknown or other
  modified_base (51)..(51): a, c, t, g, unknown or other
  modified_base (57)..(57): a, c, t, g, unknown or other
  modified_base (62)..(62): a, c, t, g, unknown or other
  modified_base (98)..(98): a, c, t, g, unknown or other
  modified_base (107)..(107): a, c, t, g, unknown or other
  modified_base (112)..(112): a, c, t, g, unknown or other
  modified_base (115)..(115): a, c, t, g, unknown or other
  modified_base (120)..(120): a, c, t, g, unknown or other
ggcncggaccatctcnggcaangccaccgggacangngcatgngctngganaaggcngtcantaggcacacacacttgtccatccagtccttgtgrcncgtgaagcntgcanccngagcnggttgtgggctgacacggaattggcrct

SEQ ID NO: 3795 - DNA, 168 bp, Artificial Sequence
  Description of Artificial Sequence: Synthetic polynucleotide
  modified_base (5)..(5): a, c, t, g, unknown or other
  modified_base (13)..(13): a, c, t, g, unknown or other
  modified_base (16)..(16): a, c, t, g, unknown or other
  modified_base (45)..(45): a, c, t, g, unknown or other
  modified_base (51)..(51): a, c, t, g, unknown or other
  modified_base (55)..(55): a, c, t, g, unknown or other
  modified_base (64)..(64): a, c, t, g, unknown or other
  modified_base (100)..(100): a, c, t, g, unknown or other
  modified_base (111)..(111): a, c, t, g, unknown or other
  modified_base (134)..(134): a, c, t, g, unknown or other
  modified_base (150)..(150): a, c, t, g, unknown or other
  modified_base (160)..(160): a, c, t, g, unknown or other
aagcntaagagantgnttttatttcaagaataactaaggktatantaayancatnatctcaaantaacattgmattattgaagacatactgttccaatantcaaacagttnacagagaggggacaggaaccaanactggaaaaacacacntgtattatantaaaaatc

SEQ ID NO: 3796 - DNA, 412 bp, Artificial Sequence
  Description of Artificial Sequence: Synthetic polynucleotide
  modified_base (116)..(116): a, c, t, g, unknown or other
  modified_base (181)..(181): a, c, t, g, unknown or other
  modified_base (197)..(197): a, c, t, g, unknown or other
  modified_base (248)..(248): a, c, t, g, unknown or other
  modified_base (260)..(260): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcngccccaaggtcactcnaaatgccacctccttcagttactctctyctttgttcaatgcctcctttatnacactgtctgcnttatgcctagccctgggtatgttatttctcttacyacctgaatagnggggaggctcttccaagggaagaccagtttcctccatgntgtggaanggtcaacacacagkaggtnctccaatatttarctgttccngctgttctgtgctccttgg

SEQ ID NO: 3797 - DNA, 344 bp, Artificial Sequence
  Description of Artificial Sequence: Synthetic polynucleotide
  modified_base (2)..(2): a, c, t, g, unknown or other
  modified_base (9)..(9): a, c, t, g, unknown or other
  modified_base (117)..(117): a, c, t, g, unknown or other
  modified_base (134)..(134): a, c, t, g, unknown or other
  modified_base (141)..(141): a, c, t, g, unknown or other
  modified_base (177)..(177): a, c, t, g, unknown or other
  modified_base (179)..(179): a, c, t, g, unknown or other
  modified_base (190)..(190): a, c, t, g, unknown or other
  modified_base (193)..(193): a, c, t, g, unknown or other
  modified_base (208)..(208): a, c, t, g, unknown or other
  modified_base (261)..(261): a, c, t, g, unknown or other
  modified_base (263)..(263): a, c, t, g, unknown or other
  modified_base (324)..(324): a, c, t, g, unknown or other
anacattancaaagaggtgggttctgttttccaggtgaaactyttagctccatgacagaccagcctgtagttatctgtgtrcacagtttacagctacaaaaacctactttggtattnattacagaaaagtgctnagttaantgtaagtgttattccttcagcaaaatattcactgancnaaaactctttntgncattttacaatgcanacagcctcatgcaagttyagacaagtggatttatactrtcttatgagtgcccncncctgatatattacctcattatgcaaaaataacatatctttcatgactattttgacaaaagnttaaaacacatatgaagttc

SEQ ID NO: 3798 - DNA, 134 bp, Artificial Sequence
  Description of Artificial Sequence: Synthetic polynucleotide
  modified_base (8)..(8): a, c, t, g, unknown or other
  modified_base (33)..(33): a, c, t, g, unknown or other
gtcacctnacttttgaatgccgcaattttctcngagtagaccctaaaagggacatagttttggatgtcagcagtacaagtagtgaagatagmgatgaagagaatgaagaactgaataaadtgcaggcattacag

SEQ ID NO: 3799 - DNA, 372 bp, Artificial Sequence
  Description of Artificial Sequence: Synthetic polynucleotide
  modified_base (22)..(22): a, c, t, g, unknown or other
  modified_base (41)..(41): a, c, t, g, unknown or other
  modified_base (110)..(110): a, c, t, g, unknown or other
  modified_base (134)..(134): a, c, t, g, unknown or other
  modified_base (136)..(136): a, c, t, g, unknown or other
  modified_base (149)..(149): a, c, t, g, unknown or other
  modified_base (156)..(156): a, c, t, g, unknown or other
  modified_base (197)..(197): a, c, t, g, unknown or other
  modified_base (213)..(213): a, c, t, g, unknown or other
  modified_base (230)..(230): a, c, t, g, unknown or other
  modified_base (257)..(257): a, c, t, g, unknown or other
  modified_base (260)..(260): a, c, t, g, unknown or other
  modified_base (329)..(329): a, c, t, g, unknown or other
  modified_base (334)..(334): a, c, t, g, unknown or other
  modified_base (336)..(336): a, c, t, g, unknown or other
  modified_base (349)..(349): a, c, t, g, unknown or other
aaaastagagatcaactttctnagytgcaaaagcttctagnctttcaagaagttcatactttatgaaattgcacaktaagcatttatttttcagaccatttttgaacatnactcctaaattaataaagtattcntntgctttagtattnattacantaaaaagggtttgaaatatagctgttctttatgcataaaanacccagctaggaccantactgccagagaaaaanatygtattgaatggccatttccctacntanaagatgtctcaatctgaatttatttggctacactaaagaatgcagtatatttagttttccatttgcatnatgtntntgtgctatagatnatattttaaattgaaaagtttgt

SEQ ID NO: 3800 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacasctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 3801 - DNA, 301 bp, Artificial Sequence
  Description of Artificial Sequence: Synthetic polynucleotide
  modified_base (37)..(37): a, c, t, g, unknown or other
  modified_base (51)..(51): a, c, t, g, unknown or other
  modified_base (75)..(75): a, c, t, g, unknown or other
  modified_base (119)..(119): a, c, t, g, unknown or other
  modified_base (124)..(124): a, c, t, g, unknown or other
  modified_base (129)..(129): a, c, t, g, unknown or other
  modified_base (141)..(141): a, c, t, g, unknown or other
  modified_base (166)..(166): a, c, t, g, unknown or other
  modified_base (168)..(168): a, c, t, g, unknown or other
  modified_base (174)..(174): a, c, t, g, unknown or other
  modified_base (245)..(245): a, c, t, g, unknown or other
  modified_base (250)..(250): a, c, t, g, unknown or other
  modified_base (270)..(270): a, c, t, g, unknown or other
  modified_base (280)..(280): a, c, t, g, unknown or other
  modified_base (297)..(297): a, c, t, g, unknown or other
tgattgmttcaacataaatactatggyttatttctanatggcaaggaaaantcacrtgtaagaggtttccwtttnaaagaattccactattcatcaaaattttcatctattctcaagantgttnatttnaaactaggtttngagtagcaaagcatatgaattttanantagaanacatgagaaggatataaaagtttgttttctgyattctttcaaaattcttattttgaaggccttctgggcanataanctattggaacttgtcatcanttaaactatntcctataaagatgarantcag

SEQ ID NO: 3802 - DNA, 375 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (53)..(53): a, c, t, g, unknown or other
  modified_base (77)..(77): a, c, t, g, unknown or other
  misc_feature (80)..(84): This region may encompass 'catca' or is absent in its entirety
  modified_base (110)..(110): a, c, t, g, unknown or other
  modified_base (124)..(124): a, c, t, g, unknown or other
  modified_base (127)..(127): a, c, t, g, unknown or other
  modified_base (131)..(131): a, c, t, g, unknown or other
  modified_base (141)..(141): a, c, t, g, unknown or other
  modified_base (184)..(184): a, c, t, g, unknown or other
  modified_base (192)..(192): a, c, t, g, unknown or other
  modified_base (199)..(199): a, c, t, g, unknown or other
  modified_base (218)..(218): a, c, t, g, unknown or other
  modified_base (242)..(242): a, c, t, g, unknown or other
  modified_base (298)..(298): a, c, t, g, unknown or other
  modified_base (303)..(303): a, c, t, g, unknown or other
  modified_base (309)..(309): a, c, t, g, unknown or other
  modified_base (333)..(333): a, c, t, g, unknown or other
  modified_base (339)..(339): a, c, t, g, unknown or other
  modified_base (351)..(351): a, c, t, g, unknown or other
  modified_base (354)..(354): a, c, t, g, unknown or other
  modified_base (369)..(369): a, c, t, g, unknown or other
ctttattgnattgctttncttatttccataagttttaggctgtaccaacaaanatcaaaaacaatagaaaattacantacatcagaggcaaacattatacacacaatggnataaactagacatnaanctanatttttattnagagcacaagtacacagacaaatatgaagcaaaaacagtgagncgacaaanatgagancatcttagtgtaaaaaatnagtgagyagcaaaataaagatgangagtactcttaacaaaaaattctgttattacaaatattgacaggcagcagattatntgacnaaaagnatcagtcacatatttgacacagtnaacagnaatttccctctnttncaattcacctttctntctttc

SEQ ID NO: 3803 - DNA, 785 bp, Artificial Sequence
  Description of Artificial Sequence: Synthetic polynucleotide
  modified_base (17)..(17): a, c, t, g, unknown or other
  modified_base (20)..(20): a, c, t, g, unknown or other
  modified_base (112)..(112): a, c, t, g, unknown or other
  modified_base (116)..(116): a, c, t, g, unknown or other
  modified_base (133)..(133): a, c, t, g, unknown or other
  modified_base (137)..(137): a, c, t, g, unknown or other
  modified_base (156)..(156): a, c, t, g, unknown or other
  modified_base (212)..(212): a, c, t, g, unknown or other
  modified_base (247)..(247): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (319)..(319): a, c, t, g, unknown or other
  modified_base (332)..(332): a, c, t, g, unknown or other
  modified_base (349)..(349): a, c, t, g, unknown or other
  modified_base (383)..(383): a, c, t, g, unknown or other
  modified_base (420)..(420): a, c, t, g, unknown or other
  modified_base (423)..(423): a, c, t, g, unknown or other
  modified_base (434)..(474): a, c, t, g, unknown or other
  modified_base (522)..(522): a, c, t, g, unknown or other
  modified_base (569)..(569): a, c, t, g, unknown or other
  modified_base (586)..(648): a, c, t, g, unknown or other
  modified_base (650)..(658): a, c, t, g, unknown or other
  modified_base (682)..(682): a, c, t, g, unknown or other
  modified_base (702)..(702): a, c, t, g, unknown or other
  modified_base (705)..(705): a, c, t, g, unknown or other
  modified_base (718)..(718): a, c, t, g, unknown or other
  modified_base (721)..(721): a, c, t, g, unknown or other
  modified_base (770)..(770): a, c, t, g, unknown or other
  modified_base (775)..(775): a, c, t, g, unknown or other
atatttttctttgcctncantgaattccctctcttggcaatgccttataagttaccatgcaaaaaaatataaatgtatctcatttatctgttctcccctaccccccacaacnctanctacctctcacaggacnaagnattggaaaggccttagtgnagccaccacctaaccayagaaatgatccaaactcacatactactacttctttattnttcagtaaagttctccaaactaaaatgaaatatgnagtttgaaaatangtagtaaaaatacagcttttnaaatatatcctctrtgctntttcatagccacttcacantgaccctacttcnccatttataactcaccnagttagttattagtaaacaactcttaatcaaaantaaaaatgaagggctatggaactgttctcatatcccnttnagtgtcttaannnnnnnnnnnnnnnnnnnnnnnnnnnnnnnnnnnnnnnnnagcgcagtgtttaatgaacttgcctaaagycacatcagaaccaccagnaagcacaatttcattgtattttgtgtgaatgccctccccagcacaangaacggagctgtacaannnnnnnnnnnnnnnnnnnnnnnnnnnnnnnnnnnnnnnnnnnnnnnnnnnnnnnnnnnnnnnrnnnnnnnnnaaaacctccaaaaaacactgcttncatcactgaaattaaagamnaanaatacaatataantanaataaaatgagaattccttgttatataataagccagtttatcagctttntttgnaaggaagaaa

SEQ ID NO: 3804 - DNA, 136 bp, Artificial Sequence
  Description of Artificial Sequence: Synthetic polynucleotide
  modified_base (7)..(7): a, c, t, g, unknown or other
  misc_feature (36)..(37): This region may encompass 'ag' or 'gc'
  modified_base (67)..(67): a, c, t, g, unknown or other
  modified_base (99)..(99): a, c, t, g, unknown or other
  modified_base (114)..(114): a, c, t, g, unknown or other
gatttcnccagaagtttgagtatcactactcctgarsagatgattgaaaaagccaaaggggaaactncctatctgccrtgcaaatttacgcttagtccngaagaccagggaccnctggacatmgagtggctgatat

SEQ ID NO: 3805 - DNA, 440 bp, Artificial Sequence
  Description of Artificial Sequence: Synthetic polynucleotide
  modified_base (117)..(117): a, c, t, g, unknown or other
  modified_base (414)..(414): a, c, t, g, unknown or other
  modified_base (437)..(437): a, c, t, g, unknown or other
gcaatggtgaatrtgatgaccacagatttttccccagccctgttctaggcagagactgggaaatgggtcattcctgtcccctattcyaattctctccttctataatggcttattttncctttttaatgttctaacctaatgtygagcaatttcagttgattttttcataagctggaaggtccatgaaatctstttctatggccattrttttctcaaacactgcagtgtcttttttcagtgttttccatatataatgatattcctaggaatatctccttggccttcctatctaarttcacccaatgtggtgttcttcatatttcaagtraattcaatactgccttcataattgttggcmcctttaaacttttattgtccctgataggtagrtgctcatcttattggttaaatgantttyggcaatttcvctttttaantta

SEQ ID NO: 3806 - DNA, 246 bp, Artificial Sequence
  Description of Artificial Sequence: Synthetic polynucleotide
  modified_base (23)..(23): a, c, t, g, unknown or other
  modified_base (27)..(27): a, c, t, g, unknown or other
  modified_base (58)..(58): a, c, t, g, unknown or other
  modified_base (67)..(67): a, c, t, g, unknown or other
  modified_base (77)..(77): a, c, t, g, unknown or other
  modified_base (114)..(114): a, c, t, g, unknown or other
  modified_base (138)..(138): a, c, t, g, unknown or other
  modified_base (161)..(161): a, c, t, g, unknown or other
  modified_base (178)..(178): a, c, t, g, unknown or other
  modified_base (198)..(198): a, c, t, g, unknown or other
  modified_base (202)..(202): a, c, t, g, unknown or other
  modified_base (220)..(220): a, c, t, g, unknown or other
  modified_base (232)..(232): a, c, t, g, unknown or other
  modified_base (244)..(244): a, c, t, g, unknown or other
agtatgagaatgcccttcatcantgcngcagcccatgaaggcttccaaataattctgntctctgctncctccagctncagcasaagggagctaggtcagagacaacttgaacanttcayaaarcattgttatgaaganaaatgaaaaccaggcaacaagtntattctcttagcttgtngttggcyaattgtttgcttntggnggaatgacttttgaaganttgatctagagntggaatccacantc

SEQ ID NO: 3807 - DNA, 371 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (53)..(53): a, c, t, g, unknown or other
  modified_base (77)..(77): a, c, t, g, unknown or other
  modified_base (80)..(80): a, c, t, g, unknown or other
  modified_base (106)..(106): a, c, t, g, unknown or other
  modified_base (120)..(120): a, c, t, g, unknown or other
  modified_base (123)..(123): a, c, t, g, unknown or other
  modified_base (127)..(127): a, c, t, g, unknown or other
  modified_base (137)..(137): a, c, t, g, unknown or other
  modified_base (180)..(180): a, c, t, g, unknown or other
  modified_base (188)..(188): a, c, t, g, unknown or other
  modified_base (195)..(195): a, c, t, g, unknown or other
  modified_base (214)..(214): a, c, t, g, unknown or other
  modified_base (238)..(238): a, c, t, g, unknown or other
  modified_base (299)..(299): a, c, t, g, unknown or other
  modified_base (305)..(305): a, c, t, g, unknown or other
  modified_base (329)..(329): a, c, t, g, unknown or other
  modified_base (335)..(335): a, c, t, g, unknown or other
  modified_base (347)..(347): a, c, t, g, unknown or other
  modified_base (350)..(350): a, c, t, g, unknown or other
  modified_base (365)..(365): a, c, t, g, unknown or other
ctttattgnattgctttncttatttccataagttttaggctgtaccaacaaanatcaaaaacaatagaaaattacantangaggcaaacattatacacacaatggnataaactagacatnaanctanatttttattnagagcacaagtacacagacaaatatgaagcaaaaacagtgagncgacaaanatgagancatcttagtgtaaaaaatnagtgagyagcaaaataaagatgangagtactcttaacaaaaaattctgttattacaaatattgacaggcagcagattatytgacnaaaagnatcagtcacatatttgacacagtnaacagnaatttccctctnttncaattcacctttctntctttc

SEQ ID NO: 3808 - DNA, 495 bp, Artificial Sequence
  Description of Artificial Sequence: Synthetic polynucleotide
  modified_base (52)..(52): a, c, t, g, unknown or other
  misc_feature (159)..(162): This region may encompass 'aaga' or is absent in its entirety
  modified_base (197)..(197): a, c, t, g, unknown or other
  modified_base (483)..(483): a, c, t, g, unknown or other
ctatatttttcatatactcttgggcttgaaaacagattaattctaagctttntaatattattctgtcataattgcatagtttagtgggcctatcagcatgtataagcaaatgttaatcagagccagccaaggttgtgtcttttggataccaggaaagaaagagttaccgtggctcttagagaggaattgatatggantttagtaaaaaaataaattttagtttgctatccaaaatatatgttttgtaaatagagctaagatttgactggaaatttgagaaaggttggacaattagttatgtatataagaaactgtgctgaacctgccaaattctttgaagtgggtcacaatgattgaacagagaaggtgcaagtatgatatacaggaatatcacatgacaagatttagtgggtaggtggttattgccatttggtctgttttgctatttataaccagtcttaggagttttctttaaaactcatngaagaaatgaga

SEQ ID NO: 3809 - DNA, 398 bp, Artificial Sequence
  Description of Artificial Sequence: Synthetic polynucleotide
  modified_base (5)..(5): a, c, t, g, unknown or other
  modified_base (30)..(30): a, c, t, g, unknown or other
  modified_base (42)..(42): a, c, t, g, unknown or other
  modified_base (55)..(55): a, c, t, g, unknown or other
  modified_base (57)..(57): a, c, t, g, unknown or other
  modified_base (77)..(77): a, c, t, g, unknown or other
  modified_base (94)..(94): a, c, t, g, unknown or other
  modified_base (97)..(97): a, c, t, g, unknown or other
  modified_base (99)..(99): a, c, t, g, unknown or other
  modified_base (118)..(118): a, c, t, g, unknown or other
  modified_base (180)..(180): a, c, t, g, unknown or other
  modified_base (187)..(187): a, c, t, g, unknown or other
  modified_base (202)..(202): a, c, t, g, unknown or other
  modified_base (206)..(206): a, c, t, g, unknown or other
  modified_base (226)..(226): a, c, t, g, unknown or other
  modified_base (232)..(232): a, c, t, g, unknown or other
  modified_base (234)..(234): a, c, t, g, unknown or other
  modified_base (247)..(247): a, c, t, g, unknown or other
  modified_base (274)..(274): a, c, t, g, unknown or other
  modified_base (327)..(327): a, c, t, g, unknown or other
  modified_base (334)..(334): a, c, t, g, unknown or other
  modified_base (342)..(342): a, c, t, g, unknown or other
  modified_base (350)..(350): a, c, t, g, unknown or other
  modified_base (367)..(367): a, c, t, g, unknown or other
  modified_base (374)..(374): a, c, t, g, unknown or other
  modified_base (391)..(391): a, c, t, g, unknown or other
tcccncaaatccatctacatcaaatttgtngaagtagagagngattttctttccncnggctctttagttgagtgccngaaaaagccaytggatnccncntaaaatttaacaactgaangtcatccttcataaggatttgggctcttagctccttcttctctactcacttyccattacccngaccacncctcatccagatgcngccntcagactcttcatggaaacnctttcntnattgggccagtangacttctaaggaatcatagtagacttnggccagaaaaaacagacctcacctgaaaatgctcattttgagcaagcaagatntatagcnaacttgcntggtgggncagctatttcttttttnaaaacanaaaaacaatttttaaanggatttt

SEQ ID NO: 3810 - DNA, 215 bp, Artificial Sequence
  Description of Artificial Sequence: Synthetic polynucleotide
  modified_base (7)..(7): a, c, t, g, unknown or other
  modified_base (26)..(26): a, c, t, g, unknown or other
  modified_base (60)..(60): a, c, t, g, unknown or other
  misc_feature (68)..(69): This region may encompass 'ac' or 'ct'
  modified_base (95)..(95): a, c, t, g, unknown or other
  modified_base (100)..(100): a, c, t, g, unknown or other
  modified_base (104)..(104): a, c, t, g, unknown or other
  modified_base (128)..(128): a, c, t, g, unknown or other
  modified_base (147)..(147): a, c, t, g, unknown or other
ggtagangttacatccaagaggaaanaatccaggcaaggargcacaagctgatcaagatntgtagttmygtggctgccaagttgtggtttttganagatngtcncatcagggaagactatcctcaaanagagattttacgagcattnaaggccaaatgttgtgaggaggaactggactttagggctgtggtgatggatgaggtggtgctgacaat

SEQ ID NO: 3811 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (239)..(239): a, c, t, g, unknown or other
  modified_base (241)..(241): a, c, t, g, unknown or other
  modified_base (279)..(279): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (359)..(359): a, c, t, g, unknown or other
  modified_base (389)..(389): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcyagttgttgccttcctagaaacacaggaataacctgcagcaccanccccttcngttctgtggcattgncacaatnaggaatctacttttgtgcttttacacattgaactgacaggtnanrtcaggcatcgactgtcacaggggccagtggagaggtngnagggacgcccacattcgatgaatcctgcatcayggtgttggacttcttgttnttngacactaaacttgttcacattynataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 3812 - DNA, 663 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (336)..(336): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (593)..(593): a, c, t, g, unknown or other
  modified_base (596)..(596): a, c, t, g, unknown or other
  modified_base (601)..(601): a, c, t, g, unknown or other
  modified_base (614)..(614): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccygtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggnggtaagagggctcgccagagccagnaggngngngggcagggtccctgtg

SEQ ID NO: 3813 - DNA, 151 bp, Artificial Sequence
  Description of Artificial Sequence: Synthetic polynucleotide
  modified_base (2)..(2): a, c, t, g, unknown or other
  modified_base (11)..(11): a, c, t, g, unknown or other
  modified_base (76)..(76): a, c, t, g, unknown or other
  modified_base (116)..(116): a, c, t, g, unknown or other
  modified_base (143)..(143): a, c, t, g, unknown or other
  modified_base (148)..(148): a, c, t, g, unknown or other
tnatcagaacngagtccctggtatagccaccgtcatattcygtagtttcttctagtgcttggaaatctagattctnggcttccacatataagcaattcaatttcttctggtctgantaagtactttaagggagattcattggncaccntat

SEQ ID NO: 3814 - DNA, 163 bp, Artificial Sequence
  Description of Artificial Sequence: Synthetic polynucleotide
  modified_base (13)..(13): a, c, t, g, unknown or other
  misc_feature (86)..(98): This region may encompass 'ccagagtatttct' or is absent in its entirety
  modified_base (107)..(107): a, c, t, g, unknown or other
  modified_base (125)..(125): a, c, t, g, unknown or other
  modified_base (149)..(149): a, c, t, g, unknown or other
atctaatccaacntttttatttccttcttgakgtactgcataaagtttagagattacttcattggccttaactccagagttttctccagagtatttctgccagtgcncggggaatagcttcaaangcctcagcaaacttcttaatagcntactgttcaagtcc

SEQ ID NO: 3815 - DNA, 372 bp, Artificial Sequence
  Description of Artificial Sequence: Synthetic polynucleotide
  modified_base (22)..(22): a, c, t, g, unknown or other
  modified_base (41)..(41): a, c, t, g, unknown or other
  modified_base (76)..(76): a, c, t, g, unknown or other
  modified_base (110)..(110): a, c, t, g, unknown or other
  modified_base (134)..(134): a, c, t, g, unknown or other
  modified_base (136)..(136): a, c, t, g, unknown or other
  modified_base (149)..(149): a, c, t, g, unknown or other
  modified_base (156)..(156): a, c, t, g, unknown or other
  modified_base (213)..(213): a, c, t, g, unknown or other
  modified_base (230)..(230): a, c, t, g, unknown or other
  modified_base (257)..(257): a, c, t, g, unknown or other
  modified_base (260)..(260): a, c, t, g, unknown or other
  modified_base (329)..(329): a, c, t, g, unknown or other
  modified_base (334)..(334): a, c, t, g, unknown or other
  modified_base (336)..(336): a, c, t, g, unknown or other
  modified_base (349)..(349): a, c, t, g, unknown or other
aaaastagagatcaactttctnagytgcaaaagcttctagnctttcaagaagttcatactttatgaaattgcacantaagcatttatttttcagaccatttttgaacatnactcctaaattaataaagtattcntntgctttagtattnattacantaaaaagggtttgaaatatagctgttctttatgcataaaayacccagctaggaccantactgccagagaaaaanatygtattgaatggccatttccctacntanaagatgtctcaatctgaatttatttggctacactaaagaatgcagtatatttagttttccatttgcatnatgtntntgtgctatagatnatattttaaattgaaaagtttgt

SEQ ID NO: 3816 - DNA, 272 bp, Artificial Sequence
  Description of Artificial Sequence: Synthetic polynucleotide
  modified_base (33)..(33): a, c, t, g, unknown or other
  modified_base (103)..(103): a, c, t, g, unknown or other
  modified_base (114)..(114): a, c, t, g, unknown or other
  modified_base (122)..(122): a, c, t, g, unknown or other
  modified_base (134)..(134): a, c, t, g, unknown or other
  modified_base (159)..(159): a, c, t, g, unknown or other
  modified_base (175)..(175): a, c, t, g, unknown or other
  modified_base (259)..(259): a, c, t, g, unknown or other
gggacacaagtgcaggttcagggcaaggtgtgngagcacactcagtccctggcctcggagtctctctggatggcttcttgcctagggtgactgacagaggganggatgatatgnaaaggcanctgttctcctcngacctaaccccaattcttactccangggttcatgacagccnattctgctggagactgtgtcttaaaacttyctcccctagtttctctcaagtacccctcgtgagctgtgatttcactgggctttnaactcttaggcca

SEQ ID NO: 3817 - DNA, 167 bp, Artificial Sequence
  Description of Artificial Sequence: Synthetic polynucleotide
  modified_base (26)..(26): a, c, t, g, unknown or other
  modified_base (64)..(64): a, c, t, g, unknown or other
  modified_base (88)..(88): a, c, t, g, unknown or other
agaatttattgccatgtacacttacnagagttctgagcaaggagatttaacctttcagcaaggngatgtgattttggttaccaagaangatggtgacyggtggacaggaacagtgggcgacaaggccggagtcttcccttctaactatgtgaggcttaaagattcag

SEQ ID NO: 3818 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcmccctgaaggggcagaagccaagtgaggtaggaagttagttaatga

SEQ ID NO: 3819 - DNA, 145 bp, Artificial Sequence
  Description of Artificial Sequence: Synthetic polynucleotide
  modified_base (10)..(10): a, c, t, g, unknown or other
  modified_base (19)..(19): a, c, t, g, unknown or other
  modified_base (29)..(29): a, c, t, g, unknown or other
  modified_base (60)..(60): a, c, t, g, unknown or other
  modified_base (121)..(121): a, c, t, g, unknown or other
  modified_base (131)..(131): a, c, t, g, unknown or other
  modified_base (144)..(144): a, c, t, g, unknown or other
gtgagccagnttctttgtnttacttggcntttgaaggtgcaactaaaagaaacagaccanatgtgyaggttggagatctcatctatggccartttgtggttgctaataaagacatggaacnagagatggtntgtattgacagcnt

SEQ ID NO: 3820 - DNA, 344 bp, Artificial Sequence
  Description of Artificial Sequence: Synthetic polynucleotide
  modified_base (2)..(2): a, c, t, g, unknown or other
  modified_base (9)..(9): a, c, t, g, unknown or other
  modified_base (81)..(81): a, c, t, g, unknown or other
  modified_base (117)..(117): a, c, t, g, unknown or other
  modified_base (134)..(134): a, c, t, g, unknown or other
  modified_base (177)..(177): a, c, t, g, unknown or other
  modified_base (179)..(179): a, c, t, g, unknown or other
  modified_base (190)..(190): a, c, t, g, unknown or other
  modified_base (193)..(193): a, c, t, g, unknown or other
  modified_base (208)..(208): a, c, t, g, unknown or other
  modified_base (261)..(261): a, c, t, g, unknown or other
  modified_base (263)..(263): a, c, t, g, unknown or other
  modified_base (324)..(324): a, c, t, g, unknown or other
anacattancaaagaggtgggttctgttttccaggtgaaactyttagctccatgacagaccagcctgtagttatctgtgtncacagtttacagctacaaaaacctactttggtattnattacagaaaagtgctnagttaawtgtaagtgttattccttcagcaaaatattcactgancnaaaactctttntgncattttacaatgcanacagcctcatgcaagttyagacaagtggatttatactrtcttatgagtgcccncncctgatatattacctcattatgcaaaaataacatatctttcatgactattttgacaaaagnttaaaacacatatgaagttc

SEQ ID NO: 3821 - DNA, 321 bp, Artificial Sequence
  Description of Artificial Sequence: Synthetic polynucleotide
  modified_base (30)..(30): a, c, t, g, unknown or other
  modified_base (46)..(46): a, c, t, g, unknown or other
  modified_base (49)..(49): a, c, t, g, unknown or other
  modified_base (85)..(85): a, c, t, g, unknown or other
  modified_base (92)..(92): a, c, t, g, unknown or other
  modified_base (94)..(94): a, c, t, g, unknown or other
  modified_base (106)..(106): a, c, t, g, unknown or other
  modified_base (116)..(116): a, c, t, g, unknown or other
  modified_base (130)..(130): a, c, t, g, unknown or other
  modified_base (134)..(134): a, c, t, g, unknown or other
  modified_base (155)..(155): a, c, t, g, unknown or other
  modified_base (171)..(171): a, c, t, g, unknown or other
  modified_base (180)..(180): a, c, t, g, unknown or other
  modified_base (195)..(195): a, c, t, g, unknown or other
  modified_base (204)..(204): a, c, t, g, unknown or other
  modified_base (210)..(210): a, c, t, g, unknown or other
  modified_base (214)..(214): a, c, t, g, unknown or other
  modified_base (242)..(242): a, c, t, g, unknown or other
  modified_base (261)..(261): a, c, t, g, unknown or other
  modified_base (290)..(290): a, c, t, g, unknown or other
  modified_base (292)..(292): a, c, t, g, unknown or other
  modified_base (303)..(303): a, c, t, g, unknown or other
ttattctagggtgagtgggtgcccaagggnggcagtgagtatggcngangtcacctggtggcaggktgctcagggatggccacangttctananggccctgcaggncctgagtctntagtcagttgggangctnaccttctgccccaycccaagngggttggggcagtcanggatgtagnagttttcgtaattcncagggatcntgatgngcantgagcaggcttgattctcacacacatangcagtggcctggtcttccnccktcggagggtactcaggaaaggcagcngngggacaggaanctcgaggggtccccatca

SEQ ID NO: 3822 - DNA, 664 bp, Artificial Sequence
  Description of Artificial Sequence: Synthetic polynucleotide
  modified_base (1)..(1): a, c, t, g, unknown or other
  modified_base (11)..(11): a, c, t, g, unknown or other
  modified_base (28)..(28): a, c, t, g, unknown or other
  modified_base (74)..(74): a, c, t, g, unknown or other
  modified_base (93)..(93): a, c, t, g, unknown or other
  modified_base (97)..(97): a, c, t, g, unknown or other
  modified_base (132)..(132): a, c, t, g, unknown or other
  modified_base (134)..(134): a, c, t, g, unknown or other
  modified_base (156)..(156): a, c, t, g, unknown or other
  modified_base (162)..(162): a, c, t, g, unknown or other
  modified_base (207)..(207): a, c, t, g, unknown or other
  modified_base (223)..(223): a, c, t, g, unknown or other
  modified_base (227)..(227): a, c, t, g, unknown or other
  modified_base (243)..(243): a, c, t, g, unknown or other
  modified_base (252)..(252): a, c, t, g, unknown or other
  modified_base (283)..(283): a, c, t, g, unknown or other
  modified_base (293)..(293): a, c, t, g, unknown or other
  modified_base (316)..(316): a, c, t, g, unknown or other
  modified_base (335)..(335): a, c, t, g, unknown or other
  modified_base (393)..(393): a, c, t, g, unknown or other
  modified_base (410)..(410): a, c, t, g, unknown or other
  modified_base (416)..(416): a, c, t, g, unknown or other
  modified_base (444)..(444): a, c, t, g, unknown or other
  modified_base (453)..(453): a, c, t, g, unknown or other
  modified_base (500)..(500): a, c, t, g, unknown or other
  modified_base (522)..(522): a, c, t, g, unknown or other
  modified_base (557)..(557): a, c, t, g, unknown or other
  modified_base (577)..(577): a, c, t, g, unknown or other
  modified_base (615)..(615): a, c, t, g, unknown or other
  modified_base (625)..(625): a, c, t, g, unknown or other
  modified_base (660)..(660): a, c, t, g, unknown or other
ncagartgtgncttgatctgactccaanctgatctagaattgaaggctgttaggaagactrttctcacacatanttgtactttgaaaggtggntctnaaattgtctggaggcccatggccaatatcaacagngntttgtgaggaaagagatccccntagtancagtgagcattgtcatgcacagcatgaatgctcaataaatgtacnaaattgaactaaaatntttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacraggataagtgattctaggaaatgngatacagaaaaggggtntgtgtncctgagacttctcccttgtctggggagnccrtttctncttccatgttgaatatcstcaccsaaaaagtgagacaaagtttgctntagtccagcaatagacaggatngtaccagragctgaaattatttttatagkaatagnaaagaaatttctgcaataanacttaaaaatatcaattaaaacaaagacaaatatacangatgaaacanaacagcatccaatcaatgggataggagattaaaantcat

SEQ ID NO: 3823 - DNA, 97 bp, Artificial Sequence
  Description of Artificial Sequence: Synthetic oligonucleotide
  modified_base (10)..(10): a, c, t, g, unknown or other
  modified_base (12)..(12): a, c, t, g, unknown or other
  modified_base (17)..(17): a, c, t, g, unknown or other
  modified_base (54)..(54): a, c, t, g, unknown or other
  modified_base (62)..(62): a, c, t, g, unknown or other
  modified_base (73)..(73): a, c, t, g, unknown or other
ttttttcttntntctantgtgcaacccacttcagtgccagcagcctacrggmanagaggccnggcaatggttngggctacagtttgctctggcatgg

SEQ ID NO: 3824 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaamgtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 3825 - DNA, 412 bp, Artificial Sequence
  Description of Artificial Sequence: Synthetic polynucleotide
  modified_base (181)..(181): a, c, t, g, unknown or other
  modified_base (197)..(197): a, c, t, g, unknown or other
  modified_base (248)..(248): a, c, t, g, unknown or other
  modified_base (260)..(260): a, c, t, g, unknown or other
  modified_base (295)..(295): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcyccgccacccaatcccccaacatatatgccatatatataaacatcaacctgtaaccaccctaatcngccccaaggtcactcnaaatgccacctccttcagttactctctyctttgttcaatgcctcctttatnacactgtctgcnttatgcctagccctgggtatgttatttctcttacnacctgaatagnggggaggctcttccaagggaagaccagtttcctccatgntgtggaanggtcaacacacagkaggtnctccaatatttarctgttccngctgttctgtgctccttgg

SEQ ID NO: 3826 - DNA, 271 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  misc_feature (213)..(214): This region may encompass 'tg' or 'ca'
cgacgangccaccatgaaggctggccagtgcrtcatcnggctgcagattaycaayaaacgcgccagccagtcaggcacgactgtgtacggcagagcacgaggaggcatctctacgaycccaagarcaacatcctgycccccatggaccactcgaccatcagcctccagatgggtacaagcaagtgygccagccaggtgggcatggcggctccysggacccggtggcacatctacgacacgaagctgggaatcacaagtatgacaactcttc

SEQ ID NO: 3827 - DNA, 111 bp, Artificial Sequence
  Description of Artificial Sequence: Synthetic polynucleotide
  modified_base (29)..(29): a, c, t, g, unknown or other
  modified_base (53)..(53): a, c, t, g, unknown or other
  modified_base (62)..(62): a, c, t, g, unknown or other
  modified_base (69)..(69): a, c, t, g, unknown or other
  misc_feature (77)..(77): May or may not be present
  modified_base (106)..(106): a, c, t, g, unknown or other
taggtagagttgcaaataatttggtgagnggtgcagatggaggtatctcttanctgtgaggnaataagncaagtaaattgctgagaaaaatgtgggtgggagaaantggca

SEQ ID NO: 3828 - DNA, 274 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  misc_feature (87)..(88): This region may encompass 'at' or 'cc'
  modified_base (126)..(126): a, c, t, g, unknown or other
  modified_base (162)..(162): a, c, t, g, unknown or other
  modified_base (167)..(167): a, c, t, g, unknown or other
  modified_base (169)..(169): a, c, t, g, unknown or other
  modified_base (174)..(174): a, c, t, g, unknown or other
  modified_base (232)..(232): a, c, t, g, unknown or other
gnccattgccaaagttgtggtttttcaatttatgttngagacaaaagagtccaaggagaattccacttgtgtaggttgcataagagmygacaaacaaagctgaactggataagagtataaagaaantaagagaagcaaaatgtgtgayagaggccacagatnctgcntntaganagcragatggtgacaaggtgaaaaggggctgcaaatttattaactggctcagtycttnctgagagctctgcaccatatctcctccamacaggtgcagatt

SEQ ID NO: 3829 - DNA, 320 bp, Artificial Sequence
  Description of Artificial Sequence: Synthetic polynucleotide
  modified_base (12)..(12): a, c, t, g, unknown or other
  modified_base (68)..(68): a, c, t, g, unknown or other
  modified_base (73)..(73): a, c, t, g, unknown or other
  modified_base (87)..(87): a, c, t, g, unknown or other
  modified_base (117)..(117): a, c, t, g, unknown or other
  modified_base (122)..(122): a, c, t, g, unknown or other
  modified_base (124)..(124): a, c, t, g, unknown or other
  modified_base (137)..(137): a, c, t, g, unknown or other
  modified_base (140)..(140): a, c, t, g, unknown or other
  modified_base (203)..(203): a, c, t, g, unknown or other
  modified_base (211)..(211): a, c, t, g, unknown or other
  modified_base (221)..(221): a, c, t, g, unknown or other
  modified_base (261)..(261): a, c, t, g, unknown or other
  modified_base (267)..(267): a, c, t, g, unknown or other
  modified_base (286)..(286): a, c, t, g, unknown or other
  modified_base (293)..(293): a, c, t, g, unknown or other
  modified_base (303)..(303): a, c, t, g, unknown or other
  modified_base (314)..(314): a, c, t, g, unknown or other
cttctgtccttntttatggtaaaagtagggaactctgcttatgcacatcaacggaatcattattayancaganccttggactggggnattttgtaccccattggctcacctttcrtnttacnanagaaggctttctnacngagttttygtcacactccttccccgccmgttgcccctcgttgtgcctgaagattmgctcwtgncgcctgangaagaaagtngtctgccttacgaccaaaagcctgtggcaaattttgagtnctttcnatcagggccgttgcctggntgcatgnactcaccccnaaagtccctcntttatc

SEQ ID NO: 3830 - DNA, 173 bp, Artificial Sequence
  Description of Artificial Sequence: Synthetic polynucleotide
  modified_base (12)..(12): a, c, t, g, unknown or other
  modified_base (23)..(23): a, c, t, g, unknown or other
  modified_base (33)..(33): a, c, t, g, unknown or other
  modified_base (68)..(68): a, c, t, g, unknown or other
  modified_base (71)..(71): a, c, t, g, unknown or other
  modified_base (73)..(73): a, c, t, g, unknown or other
  modified_base (105)..(105): a, c, t, g, unknown or other
  modified_base (112)..(112): a, c, t, g, unknown or other
  modified_base (130)..(130): a, c, t, g, unknown or other
  modified_base (162)..(162): a, c, t, g, unknown or other
  modified_base (166)..(166): a, c, t, g, unknown or other
cctcatgagagnggaatttggtncatccagttnacgcagggcatattccatgtcttcttttctgaganacncnaccatccccactccatccttctgcacatcmgntaacagncatccccagcttctcgcntgtgatccttcaggtcctgccagctgcctgankgangaagtcc

SEQ ID NO: 3831 - DNA, 100 bp, Artificial Sequence
  Description of Artificial Sequence: Synthetic polynucleotide
  modified_base (26)..(26): a, c, t, g, unknown or other
  modified_base (35)..(35): a, c, t, g, unknown or other
  modified_base (37)..(37): a, c, t, g, unknown or other
  modified_base (44)..(44): a, c, t, g, unknown or other
  modified_base (46)..(46): a, c, t, g, unknown or other
  modified_base (50)..(50): a, c, t, g, unknown or other
  modified_base (69)..(69): a, c, t, g, unknown or other
gagaaagggccaggagctgagacttngagcctatncnaaaaagngntttngcaaggagcatgccaagtngaaccytactgcaggggtggcttttgaatac

SEQ ID NO: 3832 - DNA, 100 bp, Artificial Sequence
  Description of Artificial Sequence: Synthetic polynucleotide
atttattttccttcacctggtgttgaygtttcagtgtggctacttccagttttagcatggcaatttcctttttcaacatgcaattttcatgaaagagatc

SEQ ID NO: 3833 - DNA, 412 bp, Artificial Sequence
  Description of Artificial Sequence: Synthetic polynucleotide
  modified_base (116)..(116): a, c, t, g, unknown or other
  modified_base (197)..(197): a, c, t, g, unknown or other
  modified_base (248)..(248): a, c, t, g, unknown or other
  modified_base (260)..(260): a, c, t, g, unknown or other
  modified_base (295)..(295): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcrgccccaaggtcactcnaaatgccacctccttcagttactctctyctttgttcaatgcctcctttatnacactgtctgcnttatgcctagccctgggtatgttatttctcttacnacctgaatagnggggaggctcttccaagggaagaccagtttcctccatgntgtggaanggtcaacacacagkaggtnctccaatatttarctgttccngctgttctgtgctccttgg

SEQ ID NO: 3834 - DNA, 371 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (77)..(77): a, c, t, g, unknown or other
  modified_base (80)..(80): a, c, t, g, unknown or other
  modified_base (106)..(106): a, c, t, g, unknown or other
  modified_base (120)..(120): a, c, t, g, unknown or other
  modified_base (123)..(123): a, c, t, g, unknown or other
  modified_base (127)..(127): a, c, t, g, unknown or other
  modified_base (137)..(137): a, c, t, g, unknown or other
  modified_base (180)..(180): a, c, t, g, unknown or other
  modified_base (188)..(188): a, c, t, g, unknown or other
  modified_base (195)..(195): a, c, t, g, unknown or other
  modified_base (214)..(214): a, c, t, g, unknown or other
  modified_base (238)..(238): a, c, t, g, unknown or other
  modified_base (294)..(294): a, c, t, g, unknown or other
  modified_base (299)..(299): a, c, t, g, unknown or other
  modified_base (305)..(305): a, c, t, g, unknown or other
  modified_base (329)..(329): a, c, t, g, unknown or other
  modified_base (335)..(335): a, c, t, g, unknown or other
  modified_base (347)..(347): a, c, t, g, unknown or other
  modified_base (350)..(350): a, c, t, g, unknown or other
  modified_base (365)..(365): a, c, t, g, unknown or other
ctttattgnattgctttncttatttccataagttttaggctgtaccaacaaayatcaaaaacaatagaaaattacantangaggcaaacattatacacacaatggnataaactagacatnaanctanatttttattnagagcacaagtacacagacaaatatgaagcaaaaacagtgagncgacaaanatgagancatcttagtgtaaaaaatnagtgagyagcaaaataaagatgangagtactcttaacaaaaaattctgttattacaaatattgacaggcagcagattatntgacnaaaagnatcagtcacatatttgacacagtnaacagnaatttccctctnttncaattcacctttctntctttc

SEQ ID NO: 3835 - DNA, 190 bp, Artificial Sequence
  Description of Artificial Sequence: Synthetic polynucleotide
  modified_base (48)..(48): a, c, t, g, unknown or other
  modified_base (105)..(105): a, c, t, g, unknown or other
gcagtgtgccaggtgattgggatgtacgactacaccgcgcagaatgangatgagctggccttcaacaagggccagatcatcaacrtcctcaacaaggaggacccngactggtggaaaggagaagtcaatggacaagtggggctcttcccatccaattatgtgaagytgaccacagacatggacccaagcc

SEQ ID NO: 3836 - DNA, 857 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (108)..(108): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (609)..(609): a, c, t, g, unknown or other
  modified_base (660)..(660): a, c, t, g, unknown or other
  misc_feature (755)..(755): May or may not be present
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaanttcagaggtataacttcaacattaacaggtgaaaagttctacaatgactngttgcactcyatcacattanaataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatnccccttttccatttgcccttctgttttgaagtgctttttcttaaaacttaagttctttgcctccattttcttataaacccaatttcctctttaggtgcanctctacnatttgaaaggaacctttctnttgtaatttacaagctgtgantaacngctatntnattntttccaaggattaataaactgaganatgattt

SEQ ID NO: 3837 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (170)..(170): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccarctgagakggtaatttttcccttgggnattagctgctnaggacctggccagcacttttganggcttcncagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 3838 - DNA, 170 bp, Artificial Sequence
  Description of Artificial Sequence: Synthetic polynucleotide
  modified_base (16)..(16): a, c, t, g, unknown or other
  modified_base (21)..(21): a, c, t, g, unknown or other
  modified_base (42)..(42): a, c, t, g, unknown or other
  modified_base (78)..(78): a, c, t, g, unknown or other
  modified_base (91)..(91): a, c, t, g, unknown or other
  modified_base (116)..(116): a, c, t, g, unknown or other
  modified_base (123)..(123): a, c, t, g, unknown or other
  modified_base (136)..(136): a, c, t, g, unknown or other
  modified_base (146)..(146): a, c, t, g, unknown or other
  modified_base (158)..(158): a, c, t, g, unknown or other
tagacctcccctctgnttacnttggtgtcctactttcctagncagcctcttagcttccaccttcctkttgtgcttcanagccagtcttttnccttcattctaaccaccaatttctnaactctnctgtcttcattanaccaatgaanctttccacctgnatctttgttaat

SEQ ID NO: 3839 - DNA, 663 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (240)..(240): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (593)..(593): a, c, t, g, unknown or other
  modified_base (596)..(596): a, c, t, g, unknown or other
  modified_base (601)..(601): a, c, t, g, unknown or other
  modified_base (614)..(614): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccngtgtcctggaagtsctcagaggaaacatctgcccrgaacatgacatcastaaatcattaatgagacagtcactatatgacataaatccacttagcrgagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggnggtaagagggctcgccagagccagnaggngngngggcagggtccctgtg

SEQ ID NO: 3840 - DNA, 618 bp, Artificial Sequence
  Description of Artificial Sequence: Synthetic polynucleotide
  modified_base (3)..(3): a, c, t, g, unknown or other
  modified_base (20)..(20): a, c, t, g, unknown or other
  modified_base (72)..(72): a, c, t, g, unknown or other
  modified_base (115)..(115): a, c, t, g, unknown or other
  modified_base (137)..(137): a, c, t, g, unknown or other
  modified_base (205)..(205): a, c, t, g, unknown or other
  modified_base (247)..(247): a, c, t, g, unknown or other
  modified_base (274)..(274): a, c, t, g, unknown or other
  modified_base (295)..(295): a, c, t, g, unknown or other
  modified_base (313)..(313): a, c, t, g, unknown or other
  modified_base (330)..(330): a, c, t, g, unknown or other
  modified_base (332)..(332): a, c, t, g, unknown or other
  modified_base (364)..(364): a, c, t, g, unknown or other
  modified_base (387)..(387): a, c, t, g, unknown or other
  modified_base (407)..(407): a, c, t, g, unknown or other
  modified_base (420)..(420): a, c, t, g, unknown or other
  modified_base (427)..(427): a, c, t, g, unknown or other
  modified_base (435)..(435): a, c, t, g, unknown or other
  modified_base (443)..(443): a, c, t, g, unknown or other
  modified_base (445)..(445): a, c, t, g, unknown or other
  modified_base (466)..(466): a, c, t, g, unknown or other
  modified_base (468)..(468): a, c, t, g, unknown or other
  modified_base (485)..(485): a, c, t, g, unknown or other
  modified_base (493)..(493): a, c, t, g, unknown or other
  modified_base (500)..(500): a, c, t, g, unknown or other
  modified_base (508)..(508): a, c, t, g, unknown or other
  misc_feature (548)..(549): This region may encompass 'tg' or 'ca'
  modified_base (577)..(577): a, c, t, g, unknown or other
  modified_base (592)..(592): a, c, t, g, unknown or other
  modified_base (611)..(611): a, c, t, g, unknown or other
tcnaaacttttttgtttttnattaagcacattccacagtacaaagctgtcatgaataatayctgtacaattnaacagtttcaatagctgttcagacacaaatttatttcaaacanataattggcaaacataattaantacaagttagaattagactatcccagtgctttaaaacattaatatagcagtaatttacatttgctcanttatggttagcaaaataaagtccagagtatggctgggaattnactattataatcccagaaagtcagaantccttgggtgccaaagtcccntgctataatttagtaggnacaattcaaaggttgtntncatattcaaaggccatsatctcccaaggaacnaggggracttctatattaaacangcaaaaacaacaaaaaatcnattcattcattcngrattgnctcctccnctgccccntnccttccccctgggctttcctnancagtttgataytgaagntgtaggangaaaagnggtcaaanctaaatcactttcacaaccaccatcaagcttacaacatcyrccttatgaatggaggtttattgtttacnctttgagactcaacntctcaaaaacataaattangtaacat

SEQ ID NO: 3841 - DNA, 323 bp, Artificial Sequence
  Description of Artificial Sequence: Synthetic polynucleotide
  modified_base (8)..(8): a, c, t, g, unknown or other
  modified_base (13)..(13): a, c, t, g, unknown or other
  modified_base (28)..(28): a, c, t, g, unknown or other
  modified_base (32)..(32): a, c, t, g, unknown or other
  modified_base (37)..(37): a, c, t, g, unknown or other
  modified_base (62)..(62): a, c, t, g, unknown or other
  modified_base (71)..(71): a, c, t, g, unknown or other
  modified_base (75)..(75): a, c, t, g, unknown or other
  modified_base (80)..(80): a, c, t, g, unknown or other
  modified_base (109)..(109): a, c, t, g, unknown or other
  modified_base (112)..(112): a, c, t, g, unknown or other
  modified_base (160)..(160): a, c, t, g, unknown or other
  modified_base (165)..(165): a, c, t, g, unknown or other
  modified_base (171)..(171): a, c, t, g, unknown or other
  modified_base (191)..(191): a, c, t, g, unknown or other
  modified_base (195)..(195): a, c, t, g, unknown or other
  modified_base (203)..(203): a, c, t, g, unknown or other
  modified_base (221)..(221): a, c, t, g, unknown or other
  modified_base (273)..(273): a, c, t, g, unknown or other
  modified_base (285)..(285): a, c, t, g, unknown or other
  modified_base (309)..(309): a, c, t, g, unknown or other
tgaattantgaantatctaattaagcantctnccagntgttggacatttaggtcattccagnttttccttnctgnaacancctaaygatgagagaaccaaaagcttaantcnaatacagtcagaaggaaaattmtttcagttgaaggaatgaacattttncccancataanatgtaacaaattttagttcnatancaaaaatngaaaattggagttctttnctgatgatgggaaagaacaaaaagacaacatccmcttgtggttcagagtganactgaaacctgnaaarggaaggagaatcccctaaanatgggtgcaggaat

SEQ ID NO: 3842 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccywagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 3843 - DNA, 100 bp, Artificial Sequence
  Description of Artificial Sequence: Synthetic polynucleotide
  misc_feature (63)..(63): May or may not be present
cataatattgttgcagatattgccagccacctaccccagaaccattcaccactgctacaaccaccattactgacaccaccacctgtagctctcttaccct

SEQ ID NO: 3844 - DNA, 301 bp, Artificial Sequence
  Description of Artificial Sequence: Synthetic polynucleotide
  modified_base (37)..(37): a, c, t, g, unknown or other
  modified_base (51)..(51): a, c, t, g, unknown or other
  modified_base (75)..(75): a, c, t, g, unknown or other
  modified_base (119)..(119): a, c, t, g, unknown or other
  modified_base (124)..(124): a, c, t, g, unknown or other
  modified_base (129)..(129): a, c, t, g, unknown or other
  modified_base (141)..(141): a, c, t, g, unknown or other
  modified_base (168)..(168): a, c, t, g, unknown or other
  modified_base (174)..(174): a, c, t, g, unknown or other
  modified_base (206)..(206): a, c, t, g, unknown or other
  modified_base (245)..(245): a, c, t, g, unknown or other
  modified_base (250)..(250): a, c, t, g, unknown or other
  modified_base (270)..(270): a, c, t, g, unknown or other
  modified_base (280)..(280): a, c, t, g, unknown or other
  modified_base (297)..(297): a, c, t, g, unknown or other
tgattgmttcaacataaatactatggyttatttctanatggcaaggaaaantcacrtgtaagaggtttccwtttnaaagaattccactattcatcaaaattttcatctattctcaagantgttnatttnaaactaggtttngagtagcaaagcatatgaattttayantagaanacatgagaaggatataaaagtttgttttctgnattctttcaaaattcttattttgaaggccttctgggcanataanctattggaacttgtcatcanttaaactatntcctataaagatgarantcag

SEQ ID NO: 3845 - DNA, 120 bp, Artificial Sequence
  Description of Artificial Sequence: Synthetic polynucleotide
  modified_base (26)..(26): a, c, t, g, unknown or other
  modified_base (41)..(41): a, c, t, g, unknown or other
  modified_base (46)..(46): a, c, t, g, unknown or other
  modified_base (52)..(52): a, c, t, g, unknown or other
  modified_base (65)..(65): a, c, t, g, unknown or other
  modified_base (67)..(67): a, c, t, g, unknown or other
  modified_base (109)..(109): a, c, t, g, unknown or other
caacttcacagaaaccgttccccaangtgtctctgyatagnctgcnacagantcaaaagacaacntntgggwgtttgaagatgcatctcagaaggagaaagaagaaacnggacttggtcg

SEQ ID NO: 3846 - DNA, 150 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (89)..(89): a, c, t, g, unknown or other
  modified_base (102)..(102): a, c, t, g, unknown or other
  modified_base (113)..(113): a, c, t, g, unknown or other
  modified_base (137)..(137): a, c, t, g, unknown or other
  modified_base (139)..(139): a, c, t, g, unknown or other
tgtantgagaaactgntttatgatcacttggaagatttgtatagttttataaaactcarttaaaatgtctgtttcaatgacctgtattntgccagacttaantcacagayggntattaaacttgtcagaatttcttntntcattcaagcc

SEQ ID NO: 3847 - DNA, 469 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (29)..(29): a, c, t, g, unknown or other
  modified_base (31)..(31): a, c, t, g, unknown or other
  modified_base (39)..(39): a, c, t, g, unknown or other
  modified_base (57)..(57): a, c, t, g, unknown or other
  modified_base (92)..(92): a, c, t, g, unknown or other
  modified_base (99)..(99): a, c, t, g, unknown or other
  modified_base (105)..(105): a, c, t, g, unknown or other
  modified_base (137)..(137): a, c, t, g, unknown or other
  modified_base (143)..(143): a, c, t, g, unknown or other
  modified_base (150)..(150): a, c, t, g, unknown or other
  modified_base (170)..(170): a, c, t, g, unknown or other
  modified_base (173)..(173): a, c, t, g, unknown or other
  modified_base (179)..(179): a, c, t, g, unknown or other
  modified_base (214)..(214): a, c, t, g, unknown or other
  modified_base (230)..(230): a, c, t, g, unknown or other
  modified_base (252)..(252): a, c, t, g, unknown or other
  modified_base (258)..(258): a, c, t, g, unknown or other
  modified_base (277)..(277): a, c, t, g, unknown or other
  modified_base (291)..(291): a, c, t, g, unknown or other
  modified_base (323)..(323): a, c, t, g, unknown or other
  modified_base (325)..(325): a, c, t, g, unknown or other
  modified_base (340)..(340): a, c, t, g, unknown or other
  modified_base (343)..(343): a, c, t, g, unknown or other
  modified_base (346)..(346): a, c, t, g, unknown or other
  modified_base (355)..(355): a, c, t, g, unknown or other
  modified_base (361)..(361): a, c, t, g, unknown or other
  modified_base (382)..(382): a, c, t, g, unknown or other
  modified_base (395)..(395): a, c, t, g, unknown or other
  modified_base (402)..(402): a, c, t, g, unknown or other
  modified_base (407)..(407): a, c, t, g, unknown or other
  modified_base (410)..(410): a, c, t, g, unknown or other
  modified_base (412)..(412): a, c, t, g, unknown or other
  modified_base (423)..(423): a, c, t, g, unknown or other
  modified_base (425)..(425): a, c, t, g, unknown or other
  modified_base (453)..(453): a, c, t, g, unknown or other
  modified_base (467)..(467): a, c, t, g, unknown or other
agcctgacnacacatttnccaaaagcagntnaaaaaaangcaagggtctcaggctcngtcacatccaactcattcttatgtgccagggaganacagagnacattntgtgtatctgttrgattgtgaatyaccacttngcatanagactgntctcaacagtgagattcycntcntgtagnaccctcatgcttcagctaggtgcttacaggtgaanagttactcaaaaatcntcatgtagcaaatttggtttcnaccttnaattagagagactcaggcntgcaccaaggaaangtctagctatgctcttctccagcctcycaccngnctgcrggtcttagcnttnttngtatcactnggtgtnccgggcttttgtttgaatggncaacctggctgcnatcattngcagnccnantcgctctgccngntctgcaytgtctgcttcaaaagtcaggntcaccagagagagnaa

SEQ ID NO: 3848 - DNA, 344 bp, Artificial Sequence
  Description of Artificial Sequence: Synthetic polynucleotide
  modified_base (10)..(39): a, c, t, g, unknown or other
  modified_base (41)..(46): a, c, t, g, unknown or other
  modified_base (52)..(52): a, c, t, g, unknown or other
  modified_base (64)..(64): a, c, t, g, unknown or other
  modified_base (66)..(66): a, c, t, g, unknown or other
  modified_base (79)..(79): a, c, t, g, unknown or other
  modified_base (109)..(109): a, c, t, g, unknown or other
  modified_base (144)..(144): a, c, t, g, unknown or other
  modified_base (172)..(172): a, c, t, g, unknown or other
  modified_base (200)..(200): a, c, t, g, unknown or other
  modified_base (230)..(230): a, c, t, g, unknown or other
  modified_base (242)..(242): a, c, t, g, unknown or other
  modified_base (252)..(252): a, c, t, g, unknown or other
  misc_feature (278)..(279): This region may encompass 'ag' or is absent in its entirety
ataatgctgnnnnnnnnnnnnnnnnnnnnnnnnnnnnnnynnnnnngcaaantataaatataananacatatttacttntacttgtgcaaataattctataggcctgantgaaagggaatgttccacctttctacctttttttnaatgacaaatttctgataaaattccttnttacctaatgaatgacttcagtttcaanatatgctaaatgcattcagtttccagtagnctgggcacacantgtatgctanacttggtgaacttgaggactgaaagagtttcttggcctgcttgtctggaaagtgcagtggttccttgcagaccttttgtcttcattattttc

SEQ ID NO: 3849 - DNA, 372 bp, Artificial Sequence
  Description of Artificial Sequence: Synthetic polynucleotide
  modified_base (22)..(22): a, c, t, g, unknown or other
  modified_base (41)..(41): a, c, t, g, unknown or other
  modified_base (76)..(76): a, c, t, g, unknown or other
  modified_base (110)..(110): a, c, t, g, unknown or other
  modified_base (134)..(134): a, c, t, g, unknown or other
  modified_base (136)..(136): a, c, t, g, unknown or other
  modified_base (149)..(149): a, c, t, g, unknown or other
  modified_base (197)..(197): a, c, t, g, unknown or other
  modified_base (213)..(213): a, c, t, g, unknown or other
  modified_base (230)..(230): a, c, t, g, unknown or other
  modified_base (257)..(257): a, c, t, g, unknown or other
  modified_base (260)..(260): a, c, t, g, unknown or other
  modified_base (329)..(329): a, c, t, g, unknown or other
  modified_base (334)..(334): a, c, t, g, unknown or other
  modified_base (336)..(336): a, c, t, g, unknown or other
  modified_base (349)..(349): a, c, t, g, unknown or other
aaaastagagatcaactttctnagytgcaaaagcttctagnctttcaagaagttcatactttatgaaattgcacantaagcatttatttttcagaccatttttgaacatnactcctaaattaataaagtattcntntgctttagtattnattacartaaaaagggtttgaaatatagctgttctttatgcataaaanacccagctaggaccantactgccagagaaaaanatygtattgaatggccatttccctacntanaagatgtctcaatctgaatttatttggctacactaaagaatgcagtatatttagttttccatttgcatnatgtntntgtgctatagatnatattttaaattgaaaagtttgt

SEQ ID NO: 3850 - DNA, 464 bp, Artificial Sequence
  Description of Artificial Sequence: Synthetic polynucleotide
  modified_base (13)..(13): a, c, t, g, unknown or other
  modified_base (25)..(25): a, c, t, g, unknown or other
  modified_base (37)..(37): a, c, t, g, unknown or other
  modified_base (67)..(67): a, c, t, g, unknown or other
  modified_base (69)..(69): a, c, t, g, unknown or other
  modified_base (71)..(71): a, c, t, g, unknown or other
  modified_base (83)..(347): a, c, t, g, unknown or other
  modified_base (371)..(371): a, c, t, g, unknown or other
  modified_base (382)..(382): a, c, t, g, unknown or other
  misc_feature (394)..(395): This region may encompass 'gt' or 'ac'
  modified_base (439)..(439): a, c, t, g, unknown or other
  modified_base (458)..(458): a, c, t, g, unknown or other
gcagatgtgttcngatatttctaantccacctaattnaagctgaaaattctcaattgtgttaaaaantntnaaatttgtaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttttatttccaatgtagttancrtttcactcnacttttaagcaryattcttttgcactagatttctaattgaaagttgttaagaattanttgacatcctaaacttttntttttt

SEQ ID NO: 3851 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntscttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 3852 - DNA, 785 bp, Artificial Sequence
  Description of Artificial Sequence: Synthetic polynucleotide
  modified_base (17)..(17): a, c, t, g, unknown or other
  modified_base (20)..(20): a, c, t, g, unknown or other
  modified_base (112)..(112): a, c, t, g, unknown or other
  modified_base (116)..(116): a, c, t, g, unknown or other
  modified_base (133)..(133): a, c, t, g, unknown or other
  modified_base (137)..(137): a, c, t, g, unknown or other
  modified_base (156)..(156): a, c, t, g, unknown or other
  modified_base (173)..(173): a, c, t, g, unknown or other
  modified_base (247)..(247): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (319)..(319): a, c, t, g, unknown or other
  modified_base (332)..(332): a, c, t, g, unknown or other
  modified_base (349)..(349): a, c, t, g, unknown or other
  modified_base (383)..(383): a, c, t, g, unknown or other
  modified_base (420)..(420): a, c, t, g, unknown or other
  modified_base (423)..(423): a, c, t, g, unknown or other
  modified_base (434)..(474): a, c, t, g, unknown or other
  modified_base (522)..(522): a, c, t, g, unknown or other
  modified_base (569)..(569): a, c, t, g, unknown or other
  modified_base (586)..(648): a, c, t, g, unknown or other
  modified_base (650)..(658): a, c, t, g, unknown or other
  modified_base (682)..(682): a, c, t, g, unknown or other
  modified_base (702)..(702): a, c, t, g, unknown or other
  modified_base (705)..(705): a, c, t, g, unknown or other
  modified_base (718)..(718): a, c, t, g, unknown or other
  modified_base (721)..(721): a, c, t, g, unknown or other
  modified_base (770)..(770): a, c, t, g, unknown or other
  modified_base (775)..(775): a, c, t, g, unknown or other
atatttttctttgcctncantgaattccctctcttggcaatgccttataagttaccatgcaaaaaaatataaatgtatctcatttatctgttctcccctaccccccacaacnctanctacctctcacaggacnaagnattggaaaggccttagtgnagccaccacctaaccanagaaatgatccaaactcacatactactacttctttattyttcagtaaagttctccaaactaaaatgaaatatgnagtttgaaaatangtagtaaaaatacagcttttnaaatatatcctctrtgctntttcatagccacttcacantgaccctacttcnccatttataactcaccnagttagttattagtaaacaactcttaatcaaaantaaaaatgaagggctatggaactgttctcatatcccnttnagtgtcttaannnnnnnnnnnnnnnnnnnnnnnnnnnnnnnnnnnnnnnnnagcgcagtgtttaatgaacttgcctaaagycacatcagaaccaccagnaagcacaatttcattgtattttgtgtgaatgccctccccagcacaangaacggagctgtacaannnnnnnnnnnnnnnnnnnnnnnnnnnnnnnnnnnnnnnnnnnnnnnnnnnnnnnnnnnnnnnrnnnnnnnnnaaaacctccaaaaaacactgcttncatcactgaaattaaagamnaanaatacaatataantanaataaaatgagaattccttgttatataataagccagtttatcagctttntttgnaaggaagaaa

SEQ ID NO: 3853 - DNA, 174 bp, Artificial Sequence
  Description of Artificial Sequence: Synthetic polynucleotide
  modified_base (5)..(5): a, c, t, g, unknown or other
  modified_base (17)..(17): a, c, t, g, unknown or other
  modified_base (100)..(100): a, c, t, g, unknown or other
  modified_base (113)..(113): a, c, t, g, unknown or other
  modified_base (131)..(131): a, c, t, g, unknown or other
  modified_base (150)..(150): a, c, t, g, unknown or other
acatnatattatatttntttgcataatgaagagccatgtctgccactttgccacctgttactacracatttgcaccagtatcagcaatagctttgacttntgcatccatgagnttttcttctcccttactnaahttcatcaattcttcancagtctttatcaacactgttccct

SEQ ID NO: 3854 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttccncttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattyacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 3855 - DNA, 226 bp, Artificial Sequence
  Description of Artificial Sequence: Synthetic polynucleotide
  modified_base (7)..(7): a, c, t, g, unknown or other
  modified_base (11)..(11): a, c, t, g, unknown or other
  modified_base (17)..(17): a, c, t, g, unknown or other
  modified_base (19)..(19): a, c, t, g, unknown or other
  modified_base (30)..(30): a, c, t, g, unknown or other
  modified_base (46)..(46): a, c, t, g, unknown or other
  modified_base (52)..(52): a, c, t, g, unknown or other
  modified_base (109)..(109): a, c, t, g, unknown or other
  modified_base (122)..(122): a, c, t, g, unknown or other
  modified_base (127)..(127): a, c, t, g, unknown or other
  modified_base (134)..(134): a, c, t, g, unknown or other
  modified_base (140)..(140): a, c, t, g, unknown or other
  modified_base (173)..(173): a, c, t, g, unknown or other
  modified_base (185)..(185): a, c, t, g, unknown or other
  modified_base (194)..(194): a, c, t, g, unknown or other
  modified_base (206)..(206): a, c, t, g, unknown or other
  modified_base (211)..(211): a, c, t, g, unknown or other
  modified_base (222)..(222): a, c, t, g, unknown or other
cctccancaynaaatgncntcctatgasanmtcattttcatttganttgganccttctgtggcttgacttgcaagttcaggtttggctcctccctcatttaycacctgnggattagacrttntttyncygcccnagctcntcagtattmtctggtacctgctggttatttttnccttctgctgtnttgttttgntctgatttgtcngcagnttccagtttancttc

SEQ ID NO: 3856 - DNA, 412 bp, Artificial Sequence
  Description of Artificial Sequence: Synthetic polynucleotide
  modified_base (116)..(116): a, c, t, g, unknown or other
  modified_base (181)..(181): a, c, t, g, unknown or other
  modified_base (197)..(197): a, c, t, g, unknown or other
  modified_base (248)..(248): a, c, t, g, unknown or other
  modified_base (295)..(295): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcngccccaaggtcactcnaaatgccacctccttcagttactctctyctttgttcaatgcctcctttatnacactgtctgcrttatgcctagccctgggtatgttatttctcttacnacctgaatagnggggaggctcttccaagggaagaccagtttcctccatgntgtggaanggtcaacacacagkaggtnctccaatatttarctgttccngctgttctgtgctccttgg

SEQ ID NO: 3857 - DNA, 570 bp, Artificial Sequence
  Description of Artificial Sequence: Synthetic polynucleotide
  modified_base (15)..(15): a, c, t, g, unknown or other
  modified_base (140)..(140): a, c, t, g, unknown or other
  modified_base (150)..(150): a, c, t, g, unknown or other
  modified_base (167)..(167): a, c, t, g, unknown or other
  modified_base (183)..(183): a, c, t, g, unknown or other
  modified_base (213)..(213): a, c, t, g, unknown or other
  modified_base (232)..(232): a, c, t, g, unknown or other
  modified_base (236)..(236): a, c, t, g, unknown or other
  modified_base (271)..(271): a, c, t, g, unknown or other
  modified_base (273)..(273): a, c, t, g, unknown or other
  modified_base (295)..(295): a, c, t, g, unknown or other
  modified_base (301)..(301): a, c, t, g, unknown or other
  modified_base (346)..(346): a, c, t, g, unknown or other
  modified_base (366)..(366): a, c, t, g, unknown or other
  modified_base (382)..(382): a, c, t, g, unknown or other
  modified_base (391)..(391): a, c, t, g, unknown or other
  modified_base (422)..(422): a, c, t, g, unknown or other
  modified_base (432)..(432): a, c, t, g, unknown or other
  modified_base (455)..(455): a, c, t, g, unknown or other
  modified_base (474)..(474): a, c, t, g, unknown or other
  modified_base (508)..(508): a, c, t, g, unknown or other
  modified_base (532)..(532): a, c, t, g, unknown or other
  modified_base (549)..(549): a, c, t, g, unknown or other
  modified_base (555)..(555): a, c, t, g, unknown or other
gtcatataaacattnagtcttccaaaatttttcaccaaaktttacttcctcayagactcctggaaaacaaaaggactctcttgttctctgaatactctccatccttgcctcaatttagatatgctcaagatggaagcacncagartgtgncttgatctgactccaanctgatctagaattganggctgttaggaagactrttctcacacatanttgtactttgaaaggtggntctnaaattgtctggaggcccatggccaatatcaacagngntttgtgaggaaagagatccccntagtancagtgagcattgtcatgcacagcatgaatgctcaataaatgtacnaaattgaactaaaatrtttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgngatacagaaaaggggtntgtgtncctgagacttctccc

SEQ ID NO: 3858 - DNA, 202 bp, Artificial Sequence
  Description of Artificial Sequence: Synthetic polynucleotide
ataaatgtgatataataatcaggtatggttttgctggggtatatattacatygytgtattttgcctagtctrtaggattagggggaatagctgtggtaaattcccacagaggcagttgcaaaactccctacacttctctctcccawttgcactttagtttgttaaaatctgctaaagctgtttctaattcacyactttgyar

SEQ ID NO: 3859 - DNA, 148 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (22)..(22): a, c, t, g, unknown or other
  modified_base (35)..(35): a, c, t, g, unknown or other
  modified_base (37)..(37): a, c, t, g, unknown or other
  modified_base (43)..(43): a, c, t, g, unknown or other
  modified_base (47)..(47): a, c, t, g, unknown or other
  modified_base (51)..(51): a, c, t, g, unknown or other
  modified_base (57)..(57): a, c, t, g, unknown or other
  modified_base (62)..(62): a, c, t, g, unknown or other
  modified_base (96)..(96): a, c, t, g, unknown or other
  modified_base (98)..(98): a, c, t, g, unknown or other
  modified_base (107)..(107): a, c, t, g, unknown or other
  modified_base (112)..(112): a, c, t, g, unknown or other
  modified_base (115)..(115): a, c, t, g, unknown or other
ggcncggaccatctcnggcaangccaccgggacangngcatgngctngganaaggcngtcantaggcacacacacttgtccatccagtccttgtgncncgtgaagcntgcanccngagcrggttgtgggctgacacggaattggcrct

SEQ ID NO: 3860 - DNA, 124 bp, Artificial Sequence
  Description of Artificial Sequence: Synthetic polynucleotide
  modified_base (3)..(3): a, c, t, g, unknown or other
  modified_base (12)..(12): a, c, t, g, unknown or other
  modified_base (26)..(26): a, c, t, g, unknown or other
  misc_feature (64)..(67): This region may encompass 'ttta' or is absent in its entirety
  modified_base (78)..(78): a, c, t, g, unknown or other
  modified_base (81)..(81): a, c, t, g, unknown or other
  modified_base (112)..(112): a, c, t, g, unknown or other
atnttgctcatntgcctgtgtgtgtnatagttctatgcacacttatgctgacgggtgactttatttaactatttattnctnacctttctttcgcaggtgcctcctcggttgntcctttaaattc

SEQ ID NO: 3861 - DNA, 203 bp, Artificial Sequence
  Description of Artificial Sequence: Synthetic polynucleotide
  modified_base (1)..(1): a, c, t, g, unknown or other
  modified_base (4)..(4): a, c, t, g, unknown or other
  modified_base (9)..(9): a, c, t, g, unknown or other
  modified_base (11)..(11): a, c, t, g, unknown or other
  modified_base (13)..(13): a, c, t, g, unknown or other
  modified_base (15)..(15): a, c, t, g, unknown or other
  modified_base (37)..(37): a, c, t, g, unknown or other
  modified_base (57)..(57): a, c, t, g, unknown or other
  modified_base (111)..(111): a, c, t, g, unknown or other
  modified_base (141)..(141): a, c, t, g, unknown or other
  modified_base (190)..(190): a, c, t, g, unknown or other
nttnttttntntnanattgctgcagcaaaaccarctncaccaaaaagccaggtaacnttaacaaaagaattccctgtatcatctggatctcaacatyggaaaaaagaagcngatagtgtttatggagaatgrgttcctgtngagaaaaatggtgaagaaaacaaagatgatgataatgttttcagcagcnatttgccctcaga

SEQ ID NO: 3862 - DNA, 150 bp, Artificial Sequence
  Description of Artificial Sequence: Synthetic polynucleotide
  modified_base (2)..(2): a, c, t, g, unknown or other
  modified_base (21)..(21): a, c, t, g, unknown or other
  modified_base (58)..(58): a, c, t, g, unknown or other
  modified_base (66)..(66): a, c, t, g, unknown or other
  modified_base (69)..(69): a, c, t, g, unknown or other
  misc_feature (90)..(91): This region may encompass 'ca' or 'tg'
  modified_base (101)..(101): a, c, t, g, unknown or other
  modified_base (114)..(114): a, c, t, g, unknown or other
  modified_base (149)..(149): a, c, t, g, unknown or other
anaaatcacatacacacacantgatccccacaccgttctcaatgcaaaggacaaatcngagcccanggnccttccctttagtagtagagyrtgcttccacnggaagaggtttantttataggaggctgtttattggtcctttaaaatgnt

SEQ ID NO: 3863 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatakcagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 3864 - DNA, 141 bp, Artificial Sequence
  Description of Artificial Sequence: Synthetic polynucleotide
  modified_base (3)..(3): a, c, t, g, unknown or other
  modified_base (9)..(9): a, c, t, g, unknown or other
  modified_base (31)..(31): a, c, t, g, unknown or other
  modified_base (41)..(41): a, c, t, g, unknown or other
  modified_base (43)..(43): a, c, t, g, unknown or other
  modified_base (51)..(51): a, c, t, g, unknown or other
  modified_base (65)..(65): a, c, t, g, unknown or other
  modified_base (102)..(102): a, c, t, g, unknown or other
  modified_base (107)..(107): a, c, t, g, unknown or other
  modified_base (131)..(131): a, c, t, g, unknown or other
  modified_base (134)..(134): a, c, t, g, unknown or other
  modified_base (137)..(137): a, c, t, g, unknown or other
agngtccanagtatatataactcctgatcantgactagatntnacttaagnaaagaacacgttgnagtaattcagatgtgccattgacacaggaggaccyangcctnagaaagacttttatctgagttacnagnttnagat

SEQ ID NO: 3865 - DNA, 255 bp, Artificial Sequence
  Description of Artificial Sequence: Synthetic polynucleotide
  modified_base (44)..(44): a, c, t, g, unknown or other
  modified_base (100)..(100): a, c, t, g, unknown or other
  modified_base (107)..(107): a, c, t, g, unknown or other
  modified_base (163)..(163): a, c, t, g, unknown or other
  modified_base (227)..(227): a, c, t, g, unknown or other
  modified_base (247)..(247): a, c, t, g, unknown or other
atttagtctaccaaactacaattagtgttgttttcatttttgtnctctatatgcatgttgccatttttacacttcttcagaaaaacattgagaatttttntacactnactatttccatttgtgcctaaggacaactttttctttttcttctytttttttttgnaagaaattygtttatgaacttagataaaatttatagctttgcttgaaaatttggtacttactanctttgcaattctctttattnattattac

SEQ ID NO: 3866 - DNA, 128 bp, Artificial Sequence
  Description of Artificial Sequence: Synthetic polynucleotide
  modified_base (14)..(14): a, c, t, g, unknown or other
  modified_base (17)..(17): a, c, t, g, unknown or other
  misc_feature (45)..(48): This region may encompass 'gttt' or is absent in its entirety
  modified_base (60)..(60): a, c, t, g, unknown or other
  modified_base (88)..(88): a, c, t, g, unknown or other
  modified_base (123)..(123): a, c, t, g, unknown or other
  modified_base (125)..(125): a, c, t, g, unknown or other
  modified_base (128)..(128): a, c, t, g, unknown or other
gggattttctattnatnttatgatttgaaatcattcaggactttgtttcttttgatgctnataattctttaaccatttcrgaactgantgatgyatttataatgctacaacagaatcttattngntgn

SEQ ID NO: 3867 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagsctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 3868 - DNA, 866 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (280)..(280): a, c, t, g, unknown or other
  modified_base (297)..(297): a, c, t, g, unknown or other
  modified_base (326)..(326): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  modified_base (376)..(376): a, c, t, g, unknown or other
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  modified_base (583)..(583): a, c, t, g, unknown or other
  modified_base (617)..(617): a, c, t, g, unknown or other
  modified_base (648)..(648): a, c, t, g, unknown or other
  modified_base (673)..(673): a, c, t, g, unknown or other
  modified_base (697)..(697): a, c, t, g, unknown or other
  modified_base (711)..(711): a, c, t, g, unknown or other
  modified_base (716)..(716): a, c, t, g, unknown or other
  modified_base (733)..(733): a, c, t, g, unknown or other
  modified_base (798)..(798): a, c, t, g, unknown or other
  modified_base (800)..(800): a, c, t, g, unknown or other
  modified_base (814)..(814): a, c, t, g, unknown or other
  modified_base (828)..(828): a, c, t, g, unknown or other
  modified_base (837)..(837): a, c, t, g, unknown or other
  modified_base (854)..(854): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaastttcactttaaatggattntaaaattattttcccanamacatgacagtttcttatatttggactngangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaagnarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 3869 - DNA, 343 bp, Artificial Sequence
  Description of Artificial Sequence: Synthetic polynucleotide
  modified_base (10)..(39): a, c, t, g, unknown or other
  modified_base (41)..(46): a, c, t, g, unknown or other
  modified_base (52)..(52): a, c, t, g, unknown or other
  modified_base (64)..(64): a, c, t, g, unknown or other
  modified_base (66)..(66): a, c, t, g, unknown or other
  modified_base (79)..(79): a, c, t, g, unknown or other
  modified_base (109)..(109): a, c, t, g, unknown or other
  misc_feature (144)..(144): May or may not be present
  modified_base (172)..(172): a, c, t, g, unknown or other
  modified_base (200)..(200): a, c, t, g, unknown or other
  modified_base (230)..(230): a, c, t, g, unknown or other
  modified_base (242)..(242): a, c, t, g, unknown or other
  modified_base (252)..(252): a, c, t, g, unknown or other
  modified_base (278)..(278): a, c, t, g, unknown or other
ataatgctgnnnnnnnnnnnnnnnnnnnnnnnnnnnnnnynnnnnngcaaantataaatataananacatatttacttntacttgtgcaaataattctataggcctgantgaaagggaatgttccacctttctaccttttttttaatgacaaatttctgataaaattccttnttacctaatgaatgacttcagtttcaanatatgctaaatgcattcagtttccagtagnctgggcacacantgtatgctanacttggtgaacttgaggactgaaagntttcttggcctgcttgtctggaaagtgcagtggttccttgcagaccttttgtcttcattattttc

SEQ ID NO: 3870 - DNA, 250 bp, Artificial Sequence
  Description of Artificial Sequence: Synthetic polynucleotide
  modified_base (3)..(3): a, c, t, g, unknown or other
  modified_base (33)..(33): a, c, t, g, unknown or other
  modified_base (45)..(45): a, c, t, g, unknown or other
  modified_base (56)..(56): a, c, t, g, unknown or other
  modified_base (166)..(166): a, c, t, g, unknown or other
  modified_base (170)..(170): a, c, t, g, unknown or other
  modified_base (208)..(208): a, c, t, g, unknown or other
  modified_base (211)..(211): a, c, t, g, unknown or other
ttnaaagtgttattgtttaaaaaatgaaaaaangcayatctgctnaagagctgtcngttttcattactgactctgtaaaatacactgttctttgtgtactgtgtgttattttgccagctgctgcattagccttcaaaagtattyggaaacttaagatgaactacantttnttgcaaagtacattcctttctgtggtattttktcctgnaangaagmatagtaattattttatggaaatgttagcaattct

SEQ ID NO: 3871 - DNA, 151 bp, Artificial Sequence
  Description of Artificial Sequence: Synthetic polynucleotide
  modified_base (18)..(18): a, c, t, g, unknown or other
  modified_base (42)..(42): a, c, t, g, unknown or other
  modified_base (45)..(45): a, c, t, g, unknown or other
  modified_base (85)..(85): a, c, t, g, unknown or other
  modified_base (87)..(87): a, c, t, g, unknown or other
  modified_base (118)..(118): a, c, t, g, unknown or other
  modified_base (126)..(126): a, c, t, g, unknown or other
  modified_base (130)..(130): a, c, t, g, unknown or other
  modified_base (147)..(147): a, c, t, g, unknown or other
acacctgggaggttctcnaggacactctgaaggaactcaggntcntgcatcacgycgtaatcatcctcctccttggctggctsrnangtgtccatggctgagctggcatcaatgtctnctgattcngccnggccaaactctgctccntgca

SEQ ID NO: 3872 - DNA, 690 bp, Artificial Sequence
  Description of Artificial Sequence: Synthetic polynucleotide
  modified_base (7)..(7): a, c, t, g, unknown or other
  modified_base (12)..(12): a, c, t, g, unknown or other
  modified_base (20)..(20): a, c, t, g, unknown or other
  modified_base (34)..(34): a, c, t, g, unknown or other
  modified_base (40)..(40): a, c, t, g, unknown or other
  modified_base (46)..(46): a, c, t, g, unknown or other
  modified_base (53)..(53): a, c, t, g, unknown or other
  modified_base (61)..(61): a, c, t, g, unknown or other
  modified_base (66)..(66): a, c, t, g, unknown or other
  modified_base (91)..(91): a, c, t, g, unknown or other
  modified_base (119)..(119): a, c, t, g, unknown or other
  modified_base (140)..(140): a, c, t, g, unknown or other
  modified_base (154)..(154): a, c, t, g, unknown or other
  modified_base (174)..(174): a, c, t, g, unknown or other
  modified_base (176)..(176): a, c, t, g, unknown or other
  modified_base (218)..(218): a, c, t, g, unknown or other
  modified_base (223)..(223): a, c, t, g, unknown or other
  modified_base (242)..(242): a, c, t, g, unknown or other
  modified_base (244)..(244): a, c, t, g, unknown or other
  modified_base (259)..(259): a, c, t, g, unknown or other
  modified_base (267)..(267): a, c, t, g, unknown or other
  modified_base (276)..(276): a, c, t, g, unknown or other
  modified_base (284)..(284): a, c, t, g, unknown or other
  modified_base (289)..(289): a, c, t, g, unknown or other
  modified_base (318)..(318): a, c, t, g, unknown or other
  modified_base (329)..(329): a, c, t, g, unknown or other
  modified_base (362)..(362): a, c, t, g, unknown or other
  modified_base (372)..(372): a, c, t, g, unknown or other
  modified_base (386)..(386): a, c, t, g, unknown or other
  modified_base (394)..(394): a, c, t, g, unknown or other
  modified_base (401)..(401): a, c, t, g, unknown or other
  modified_base (409)..(409): a, c, t, g, unknown or other
  modified_base (449)..(449): a, c, t, g, unknown or other
  modified_base (456)..(456): a, c, t, g, unknown or other
  modified_base (483)..(483): a, c, t, g, unknown or other
  modified_base (540)..(540): a, c, t, g, unknown or other
  modified_base (547)..(547): a, c, t, g, unknown or other
  modified_base (553)..(553): a, c, t, g, unknown or other
  modified_base (580)..(580): a, c, t, g, unknown or other
  modified_base (616)..(616): a, c, t, g, unknown or other
  modified_base (620)..(620): a, c, t, g, unknown or other
  modified_base (683)..(683): a, c, t, g, unknown or other
tgatgcnaacangcatcatntctggccactgaanccaggntcttangtttaancataaaangcttngtctcatgggctgcaaaccaccaanatagaactaagattgataagaaaaatanactgtttactcaaaacaggtntataccagcctacntatttataatgtcctattananggttgtacagttcrtatcctcaataattcagtaggtatcycnctaanatctatttgaaatcccccnanaataacatttagcantagcttcntgatctctntagaatgntgtcnttatttttcttaaacatttgatatgttanaccacccaggnggaaaatagaacacagagtgtaggatacacacntactcaccanaaaaacaaccatantgtaacancaaaatntatttatnaattggtcaaggaaattgaatttaacatatgctgttatcntacaagnatttttaatgaaataacatyttgtatntatatagcacctttctactaaggagcaaaaatatggctcagayattattactcattntcacacnatcctngacaggtggataagtagyaacatttanaccaagttttaatcactgggaaacaaagacatgcanaaanagagcaaataaaccacaaatggtaacccagaaagttggcattttccaccccccaatgcccacngtggtcc

SEQ ID NO: 3873 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcntaatttttcactaggtgataattccctttgggaagaagtgcnttatctttaattattccactttttgttawatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaanaccttttatggctcagtgctcattc

SEQ ID NO: 3874 - DNA, 263 bp, Artificial Sequence
  Description of Artificial Sequence: Synthetic polynucleotide
  modified_base (51)..(51): a, c, t, g, unknown or other
  modified_base (59)..(59): a, c, t, g, unknown or other
  modified_base (84)..(84): a, c, t, g, unknown or other
  modified_base (87)..(87): a, c, t, g, unknown or other
  modified_base (136)..(136): a, c, t, g, unknown or other
  modified_base (261)..(261): a, c, t, g, unknown or other
ctatttctaccttctaatgagaattttaaaaactataaacatgattttttnaaaaaaanattgagtttccaaaaagaaaggaangangattaatccagaaactccacatcttcctggattggagggtaccctatcnttcaaaaattcttccagagtatcatawgtttcagayggattcaagcagaatattttttcaaagatcagtaagcggtgcrcttagaagagaaacagcctctctrcatctaagactgtgagtattanaa

SEQ ID NO: 3875 - DNA, 147 bp, Artificial Sequence
  Description of Artificial Sequence: Synthetic polynucleotide
  modified_base (7)..(7): a, c, t, g, unknown or other
  modified_base (23)..(23): a, c, t, g, unknown or other
  modified_base (41)..(41): a, c, t, g, unknown or other
  modified_base (44)..(44): a, c, t, g, unknown or other
  modified_base (59)..(59): a, c, t, g, unknown or other
  modified_base (104)..(104): a, c, t, g, unknown or other
taaagcnaatttcttttcttctntattctctagatccatgnttnaaaaagagggatttncaaaattcaccagcagtccttaggattacattggtactgaagtanagckagggaaaaaaaaaagtaaaattggagatgagataaaact

SEQ ID NO: 3876 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagmaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 3877 - DNA, 83 bp, Artificial Sequence
  Description of Artificial Sequence: Synthetic oligonucleotide
  modified_base (20)..(20): a, c, t, g, unknown or other
  modified_base (73)..(73): a, c, t, g, unknown or other
gcttctctaagctactttanccttagtattaaggaaktatctggtatttaaggaattgcccagggtcgactanggtcttgggt

SEQ ID NO: 3878 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (351)..(351): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (737)..(737): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagngtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccrcccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 3879 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccycaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 3880 - DNA, 517 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  misc_feature (184)..(185): This region may encompass 'ca' or 'gg'
  modified_base (216)..(216): a, c, t, g, unknown or other
  modified_base (219)..(219): a, c, t, g, unknown or other
  modified_base (244)..(244): a, c, t, g, unknown or other
  modified_base (251)..(251): a, c, t, g, unknown or other
  modified_base (259)..(259): a, c, t, g, unknown or other
  modified_base (273)..(273): a, c, t, g, unknown or other
  modified_base (275)..(275): a, c, t, g, unknown or other
  modified_base (306)..(306): a, c, t, g, unknown or other
  modified_base (311)..(311): a, c, t, g, unknown or other
  modified_base (313)..(313): a, c, t, g, unknown or other
  modified_base (316)..(316): a, c, t, g, unknown or other
  modified_base (336)..(336): a, c, t, g, unknown or other
  modified_base (382)..(382): a, c, t, g, unknown or other
  modified_base (404)..(404): a, c, t, g, unknown or other
  modified_base (414)..(414): a, c, t, g, unknown or other
  modified_base (442)..(442): a, c, t, g, unknown or other
  modified_base (457)..(457): a, c, t, g, unknown or other
  modified_base (459)..(459): a, c, t, g, unknown or other
  modified_base (478)..(478): a, c, t, g, unknown or other
  modified_base (481)..(481): a, c, t, g, unknown or other
  modified_base (496)..(496): a, c, t, g, unknown or other
  modified_base (501)..(501): a, c, t, g, unknown or other
  modified_base (514)..(514): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagsraagtaaaaggcatcccattagtcttttcagntcntagtcaaggacaatkatcatgaatnaatctgnttactatntacttaacacaagntntgagaagaaaagcatcatagttctgaaatgntgatngntcnctaagccacaaatgagaggnaggtttcccacctatctcagttgataatgtccaaaaacatccttcnccatgcatcagagtagaaaganaatgtacctnctactatgtcaaatggaatagataactncaaartaggaacacntnagaacattctctaacattntancagtctgatgcttcnccttntctgccacttcanara

SEQ ID NO: 3881 - DNA, 570 bp, Artificial Sequence
  Description of Artificial Sequence: Synthetic polynucleotide
  modified_base (15)..(15): a, c, t, g, unknown or other
  modified_base (53)..(53): a, c, t, g, unknown or other
  modified_base (140)..(140): a, c, t, g, unknown or other
  modified_base (150)..(150): a, c, t, g, unknown or other
  modified_base (167)..(167): a, c, t, g, unknown or other
  modified_base (183)..(183): a, c, t, g, unknown or other
  modified_base (213)..(213): a, c, t, g, unknown or other
  modified_base (232)..(232): a, c, t, g, unknown or other
  modified_base (236)..(236): a, c, t, g, unknown or other
  modified_base (271)..(271): a, c, t, g, unknown or other
  modified_base (273)..(273): a, c, t, g, unknown or other
  modified_base (301)..(301): a, c, t, g, unknown or other
  modified_base (346)..(346): a, c, t, g, unknown or other
  modified_base (366)..(366): a, c, t, g, unknown or other
  modified_base (382)..(382): a, c, t, g, unknown or other
  modified_base (391)..(391): a, c, t, g, unknown or other
  modified_base (422)..(422): a, c, t, g, unknown or other
  modified_base (432)..(432): a, c, t, g, unknown or other
  modified_base (455)..(455): a, c, t, g, unknown or other
  modified_base (474)..(474): a, c, t, g, unknown or other
  modified_base (508)..(508): a, c, t, g, unknown or other
  modified_base (532)..(532): a, c, t, g, unknown or other
  modified_base (549)..(549): a, c, t, g, unknown or other
  modified_base (555)..(555): a, c, t, g, unknown or other
gtcatataaacattnagtcttccaaaatttttcaccaaaktttacttcctcanagactcctggaaaacaaaaggactctcttgttctctgaatactctccatccttgcctcaatttagatatgctcaagatggaagcacncagartgtgncttgatctgactccaanctgatctagaattganggctgttaggaagactrttctcacacatanttgtactttgaaaggtggntctnaaattgtctggaggcccatggccaatatcaacagngntttgtgaggaaagagatccccytagtancagtgagcattgtcatgcacagcatgaatgctcaataaatgtacnaaattgaactaaaatrtttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgngatacagaaaaggggtntgtgtncctgagacttctccc

SEQ ID NO: 3882 - DNA, 165 bp, Artificial Sequence
  Description of Artificial Sequence: Synthetic polynucleotide
  modified_base (22)..(22): a, c, t, g, unknown or other
  modified_base (30)..(30): a, c, t, g, unknown or other
  modified_base (32)..(85): a, c, t, g, unknown or other
  modified_base (154)..(154): a, c, t, g, unknown or other
  modified_base (160)..(160): a, c, t, g, unknown or other
ccagcccacacagtcacatccnggacacanrnnnnnnnnnnnnnnnnnnnnnnnnnnnnnnnnnnnnnnnnnnnnnnnnnnnnnntgkcatcagctttgattcttaaacccctttaccccaamcctggcccccaagcagaggcagcaggtcagnaacagnacata

SEQ ID NO: 3883 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttsggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 3884 - DNA, 246 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (72)..(72): a, c, t, g, unknown or other
  modified_base (86)..(86): a, c, t, g, unknown or other
  modified_base (106)..(106): a, c, t, g, unknown or other
  modified_base (112)..(112): a, c, t, g, unknown or other
  modified_base (141)..(141): a, c, t, g, unknown or other
  modified_base (146)..(146): a, c, t, g, unknown or other
  modified_base (148)..(148): a, c, t, g, unknown or other
  modified_base (150)..(150): a, c, t, g, unknown or other
  modified_base (171)..(171): a, c, t, g, unknown or other
  modified_base (201)..(201): a, c, t, g, unknown or other
  modified_base (215)..(215): a, c, t, g, unknown or other
  modified_base (224)..(224): a, c, t, g, unknown or other
  modified_base (229)..(229): a, c, t, g, unknown or other
  modified_base (233)..(233): a, c, t, g, unknown or other
atcrngcagaatantgtacagattttggaatcggtacagttgaaatgggaactttttcagagytggacaganttttcaaggctccntctttctaataaactggccntttttnggaattggttataacacccgttggaaagnggatntncnttaccattatgctgagatcanctcccaggtgccccttggcaagcgacttcnggagtacttcaacnctgagaagnctgangganggatcattatgac

SEQ ID NO: 3885 - DNA, 321 bp, Artificial Sequence
  Description of Artificial Sequence: Synthetic polynucleotide
  modified_base (30)..(30): a, c, t, g, unknown or other
  modified_base (46)..(46): a, c, t, g, unknown or other
  modified_base (49)..(49): a, c, t, g, unknown or other
  modified_base (85)..(85): a, c, t, g, unknown or other
  modified_base (92)..(92): a, c, t, g, unknown or other
  modified_base (94)..(94): a, c, t, g, unknown or other
  modified_base (106)..(106): a, c, t, g, unknown or other
  modified_base (116)..(116): a, c, t, g, unknown or other
  modified_base (130)..(130): a, c, t, g, unknown or other
  modified_base (134)..(134): a, c, t, g, unknown or other
  modified_base (155)..(155): a, c, t, g, unknown or other
  modified_base (171)..(171): a, c, t, g, unknown or other
  modified_base (180)..(180): a, c, t, g, unknown or other
  modified_base (195)..(195): a, c, t, g, unknown or other
  modified_base (204)..(204): a, c, t, g, unknown or other
  modified_base (210)..(210): a, c, t, g, unknown or other
  modified_base (214)..(214): a, c, t, g, unknown or other
  modified_base (261)..(261): a, c, t, g, unknown or other
  modified_base (264)..(264): a, c, t, g, unknown or other
  modified_base (290)..(290): a, c, t, g, unknown or other
  modified_base (292)..(292): a, c, t, g, unknown or other
  modified_base (303)..(303): a, c, t, g, unknown or other
ttattctagggtgagtgggtgcccaagggnggcagtgagtatggcngangtcacctggtggcaggktgctcagggatggccacangttctananggccctgcaggncctgagtctntagtcagttgggangctnaccttctgccccaycccaagngggttggggcagtcanggatgtagnagttttcgtaattcncagggatcntgatgngcantgagcaggcttgattctcacacacataygcagtggcctggtcttccnccntcggagggtactcaggaaaggcagcngngggacaggaanctcgaggggtccccatca

SEQ ID NO: 3886 - DNA, 150 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (59)..(59): a, c, t, g, unknown or other
  modified_base (102)..(102): a, c, t, g, unknown or other
  modified_base (113)..(113): a, c, t, g, unknown or other
  modified_base (137)..(137): a, c, t, g, unknown or other
  modified_base (139)..(139): a, c, t, g, unknown or other
tgtantgagaaactgntttatgatcacttggaagatttgtatagttttataaaactcanttaaaatgtctgtttcaatgacctgtattytgccagacttaantcacagayggntattaaacttgtcagaatttcttntntcattcaagcc

SEQ ID NO: 3887 - DNA, 529 bp, Artificial Sequence
  Description of Artificial Sequence: Synthetic polynucleotide
  modified_base (2)..(2): a, c, t, g, unknown or other
  modified_base (50)..(50): a, c, t, g, unknown or other
  modified_base (52)..(52): a, c, t, g, unknown or other
  modified_base (127)..(127): a, c, t, g, unknown or other
  modified_base (141)..(141): a, c, t, g, unknown or other
  modified_base (229)..(229): a, c, t, g, unknown or other
  modified_base (232)..(232): a, c, t, g, unknown or other
  modified_base (309)..(309): a, c, t, g, unknown or other
  modified_base (314)..(314): a, c, t, g, unknown or other
  modified_base (414)..(414): a, c, t, g, unknown or other
  modified_base (510)..(510): a, c, t, g, unknown or other
cnattcaaaaattaagccaataagaatcaacatataatccatgagattcncnatctaggkaagtaaacccaccctaatactgtgtttattaaaatgctgttaatgagatccgagrtttaaacaactnttcrctttagaaantgaaataaagctgactgaaataaaacctaatctatgaaattattctgtatatgaattgacctgaagtaatgaacagttcawtgactgnctnatractcttgttctggtccaggytaatcattctagttggcatactattaaacacacatttctgattgamacatctgntaaantaacatcaaacgacattacaaaatcaaaatggagactgctaagagtgggatttttctcctgccagtayctttcctttctgccacatyctcctccctgcynccacagyaatctttctraaggaatacaaatatattctgaatcacacgcaaacccctcaatacagaatgtgtggtaggcagtattctaaaatgcccncataccaccraccccacca

SEQ ID NO: 3888 - DNA, 175 bp, Artificial Sequence
  Description of Artificial Sequence: Synthetic polynucleotide
  modified_base (26)..(26): a, c, t, g, unknown or other
  modified_base (31)..(31): a, c, t, g, unknown or other
  modified_base (72)..(72): a, c, t, g, unknown or other
  modified_base (83)..(83): a, c, t, g, unknown or other
  modified_base (88)..(88): a, c, t, g, unknown or other
  modified_base (107)..(107): a, c, t, g, unknown or other
ccagaaaagctgaaacacaagccccngactnaggtctgacggcgtttacrgaggcatccagacctgggtgcncttacacaccngmacngaagccacaggctcacagntcttggataagaaccaggaaaacatrcattaagcagggtaagccccaaattatctggacagctgctgc

SEQ ID NO: 3889 - DNA, 435 bp, Artificial Sequence
  Description of Artificial Sequence: Synthetic polynucleotide
  modified_base (22)..(22): a, c, t, g, unknown or other
  modified_base (65)..(70): a, c, t, g, unknown or other
  modified_base (72)..(103): a, c, t, g, unknown or other
  modified_base (134)..(134): a, c, t, g, unknown or other
  modified_base (175)..(175): a, c, t, g, unknown or other
  misc_feature (180)..(180): May or may not be present
  modified_base (257)..(257): a, c, t, g, unknown or other
  modified_base (347)..(347): a, c, t, g, unknown or other
  modified_base (373)..(373): a, c, t, g, unknown or other
ttttaaaattatgcttaaaaanttttttattcaagctaraatttgaatatagmtaaatatcttcnnnnnnynnnnnnnnnnnnnnnnnnnnnnnnnnnnnnnnctaagagatttgcttgccaataggagcygcntaagagtgtactcaagaagaaaataacattttcctgtatanaggttaaaattaaaatgaaggggtgagagacagaccttgagaatacaaaatcatagtggacattgaactgaggaaagcacanagttcttggcaccaaaaaattaaaagatattgagatattataaaagtacaattcacatgttttatttaaatcagaaagaaaattrtgtgnttttgtataatttaattgattacaangaaataatttttagaaaattttatcaccaacttgttaaaaatagatggcacttccattgaaa

SEQ ID NO: 3890 - DNA, 412 bp, Artificial Sequence
  Description of Artificial Sequence: Synthetic polynucleotide
  modified_base (116)..(116): a, c, t, g, unknown or other
  modified_base (181)..(181): a, c, t, g, unknown or other
  modified_base (197)..(197): a, c, t, g, unknown or other
  modified_base (260)..(260): a, c, t, g, unknown or other
  modified_base (295)..(295): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcngccccaaggtcactcnaaatgccacctccttcagttactctctyctttgttcaatgcctcctttatracactgtctgcnttatgcctagccctgggtatgttatttctcttacnacctgaatagnggggaggctcttccaagggaagaccagtttcctccatgntgtggaanggtcaacacacagkaggtnctccaatatttarctgttccngctgttctgtgctccttgg

SEQ ID NO: 3891 - DNA, 344 bp, Artificial Sequence
  Description of Artificial Sequence: Synthetic polynucleotide
  modified_base (2)..(2): a, c, t, g, unknown or other
  modified_base (9)..(9): a, c, t, g, unknown or other
  modified_base (81)..(81): a, c, t, g, unknown or other
  modified_base (134)..(134): a, c, t, g, unknown or other
  modified_base (141)..(141): a, c, t, g, unknown or other
  modified_base (177)..(177): a, c, t, g, unknown or other
  modified_base (179)..(179): a, c, t, g, unknown or other
  modified_base (190)..(190): a, c, t, g, unknown or other
  modified_base (193)..(193): a, c, t, g, unknown or other
  modified_base (208)..(208): a, c, t, g, unknown or other
  modified_base (261)..(261): a, c, t, g, unknown or other
  modified_base (263)..(263): a, c, t, g, unknown or other
  modified_base (324)..(324): a, c, t, g, unknown or other
anacattancaaagaggtgggttctgttttccaggtgaaactyttagctccatgacagaccagcctgtagttatctgtgtncacagtttacagctacaaaaacctactttggtattyattacagaaaagtgctnagttaantgtaagtgttattccttcagcaaaatattcactgancnaaaactctttntgncattttacaatgcanacagcctcatgcaagttyagacaagtggatttatactrtcttatgagtgcccncncctgatatattacctcattatgcaaaaataacatatctttcatgactattttgacaaaagnttaaaacacatatgaagttc

SEQ ID NO: 3892 - DNA, 250 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (37)..(37): a, c, t, g, unknown or other
  modified_base (53)..(53): a, c, t, g, unknown or other
  modified_base (59)..(59): a, c, t, g, unknown or other
  modified_base (61)..(61): a, c, t, g, unknown or other
  misc_feature (95)..(97): This region may encompass 'aaa' or is absent in its entirety
  modified_base (125)..(125): a, c, t, g, unknown or other
  modified_base (142)..(142): a, c, t, g, unknown or other
  modified_base (164)..(164): a, c, t, g, unknown or other
  modified_base (166)..(166): a, c, t, g, unknown or other
  modified_base (177)..(177): a, c, t, g, unknown or other
  modified_base (191)..(191): a, c, t, g, unknown or other
  modified_base (194)..(194): a, c, t, g, unknown or other
  modified_base (209)..(209): a, c, t, g, unknown or other
  modified_base (211)..(211): a, c, t, g, unknown or other
  modified_base (219)..(219): a, c, t, g, unknown or other
  modified_base (225)..(225): a, c, t, g, unknown or other
caaagtaaaaacaanttygttccacaganttgtatgntctgtaggcatatggncaattntnttccgagtccttttgtcttgcactatcaaaataaaagaatctttgtcttggagcaagtctgctnaagaargcaccaaaatnctatcctccctattcccctaantnatattaataancctcttatcaatcnttncaaggtaacttcaangncattaagnattaanattctaaatatgtaaagctatagaa

SEQ ID NO: 3893 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatrcaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 3894 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (176)..(176): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgngtaggtgtttggcacccaaaatttcactgaagaagaatgctgtttcttantatcaaaccaaagtgcaaagcaatataaattagaggccaagncttctcttgncgntcnatttacttctgtaaaacagattctatgttccttttctatgancantttacatttgaaacattagattttttcactnatgagggaaggaaangggcttctgtnctacttnaagncngngaagctaaggtctccttctcaaagnagagcnggaatcagaggtgagaaatgtcggkacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 3895 - DNA, 816 bp, Artificial Sequence
  Description of Artificial Sequence: Synthetic polynucleotide
  modified_base (67)..(162): a, c, t, g, unknown or other
  modified_base (205)..(205): a, c, t, g, unknown or other
  modified_base (240)..(240): a, c, t, g, unknown or other
  modified_base (259)..(259): a, c, t, g, unknown or other
  modified_base (288)..(288): a, c, t, g, unknown or other
  modified_base (294)..(294): a, c, t, g, unknown or other
  modified_base (298)..(298): a, c, t, g, unknown or other
  modified_base (304)..(304): a, c, t, g, unknown or other
  modified_base (322)..(322): a, c, t, g, unknown or other
  modified_base (335)..(335): a, c, t, g, unknown or other
  modified_base (355)..(355): a, c, t, g, unknown or other
  modified_base (366)..(366): a, c, t, g, unknown or other
  modified_base (372)..(372): a, c, t, g, unknown or other
  modified_base (386)..(386): a, c, t, g, unknown or other
  modified_base (451)..(451): a, c, t, g, unknown or other
  modified_base (477)..(477): a, c, t, g, unknown or other
  modified_base (489)..(489): a, c, t, g, unknown or other
  modified_base (499)..(499): a, c, t, g, unknown or other
  modified_base (504)..(504): a, c, t, g, unknown or other
  modified_base (509)..(509): a, c, t, g, unknown or other
  modified_base (521)..(521): a, c, t, g, unknown or other
  modified_base (531)..(531): a, c, t, g, unknown or other
  modified_base (578)..(578): a, c, t, g, unknown or other
  modified_base (614)..(614): a, c, t, g, unknown or other
  modified_base (678)..(678): a, c, t, g, unknown or other
  modified_base (733)..(733): a, c, t, g, unknown or other
  modified_base (739)..(739): a, c, t, g, unknown or other
  modified_base (759)..(759): a, c, t, g, unknown or other
gtccactccctgagctgmgaataaatggaaagcttacacaggaattgaagaatttgaaaacgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaatgtataacattatacagagaggacagtggtaaactnaggactgctgccctttctatatgatgtaatwttanataagacaaacctataacngtctaatggaccactgtttacagtttgancaccantgcnttaccnatatttccttttaactanatctcataaattnatatgaaaaacccttatagncctattccacntaaggngaaggaaaactagnaagcatgaaaaatgaatattaatttaattaaacttttctataatggctcactgtctgttccagantctgaaaastcccaggtaccagaaanctggaaaaaaantagagccagnaaatnggacnaagaaggactcngcttycatantaaaatactcaacatccttgctgtttttaataatgtggaaagttganaatggtggtggtatkgctggtgggtttgtgtgtasntgcatgtggtgtatataattrtatacatataattacttttagagctcttgcatcttgaaaaacncccatctgtttggtaacattttatgttgtggcactttcctcacatttgaaaatgngaattntgatacaaagacrtgtattntttttttccacactaagattcagaatgttctggcacagatatttctcattcatgtta

SEQ ID NO: 3896 - DNA, 374 bp, Artificial Sequence
  Description of Artificial Sequence: Synthetic polynucleotide
  modified_base (3)..(3): a, c, t, g, unknown or other
  modified_base (15)..(15): a, c, t, g, unknown or other
  modified_base (25)..(25): a, c, t, g, unknown or other
  modified_base (40)..(40): a, c, t, g, unknown or other
  modified_base (61)..(61): a, c, t, g, unknown or other
  modified_base (80)..(80): a, c, t, g, unknown or other
  modified_base (91)..(91): a, c, t, g, unknown or other
  modified_base (99)..(99): a, c, t, g, unknown or other
  modified_base (113)..(113): a, c, t, g, unknown or other
  modified_base (136)..(136): a, c, t, g, unknown or other
  modified_base (142)..(142): a, c, t, g, unknown or other
  modified_base (147)..(147): a, c, t, g, unknown or other
  modified_base (158)..(158): a, c, t, g, unknown or other
  modified_base (212)..(212): a, c, t, g, unknown or other
  modified_base (217)..(217): a, c, t, g, unknown or other
  modified_base (272)..(272): a, c, t, g, unknown or other
  modified_base (274)..(274): a, c, t, g, unknown or other
  modified_base (295)..(295): a, c, t, g, unknown or other
  modified_base (299)..(299): a, c, t, g, unknown or other
  modified_base (301)..(301): a, c, t, g, unknown or other
  modified_base (310)..(310): a, c, t, g, unknown or other
  modified_base (322)..(322): a, c, t, g, unknown or other
  modified_base (336)..(336): a, c, t, g, unknown or other
  modified_base (352)..(352): a, c, t, g, unknown or other
  modified_base (370)..(370): a, c, t, g, unknown or other
cantcctgaggagcnctttaaaaantcattcaaggaaatnaaaaaaaaaagtctctttaangataaatgcaaattacagncatagttgganmctaaaantatgtcttgaatangaaaattaccagaggatgaattncttaanagcangactgtctttnaagagtttctaatatatttaatctccagtaaactctaggatatccaaaggtgtngtacntttttttttccagaatatgcagtgtctgagaaacttktatcacatctatccatgnantcaactaatgtcagcaaaacnagangnaaatcatanataaagggaagnatgaaaatattttnttgtaaacttctgagncatagggataaggaaagnaagt

SEQ ID NO: 3897 - DNA, 372 bp, Artificial Sequence
  Description of Artificial Sequence: Synthetic polynucleotide
  modified_base (22)..(22): a, c, t, g, unknown or other
  modified_base (41)..(41): a, c, t, g, unknown or other
  modified_base (76)..(76): a, c, t, g, unknown or other
  modified_base (110)..(110): a, c, t, g, unknown or other
  modified_base (134)..(134): a, c, t, g, unknown or other
  modified_base (136)..(136): a, c, t, g, unknown or other
  modified_base (149)..(149): a, c, t, g, unknown or other
  modified_base (156)..(156): a, c, t, g, unknown or other
  modified_base (197)..(197): a, c, t, g, unknown or other
  modified_base (213)..(213): a, c, t, g, unknown or other
  modified_base (230)..(230): a, c, t, g, unknown or other
  modified_base (257)..(257): a, c, t, g, unknown or other
  modified_base (329)..(329): a, c, t, g, unknown or other
  modified_base (334)..(334): a, c, t, g, unknown or other
  modified_base (336)..(336): a, c, t, g, unknown or other
  modified_base (349)..(349): a, c, t, g, unknown or other
aaaastagagatcaactttctnagytgcaaaagcttctagnctttcaagaagttcatactttatgaaattgcacantaagcatttatttttcagaccatttttgaacatnactcctaaattaataaagtattcntntgctttagtattnattacantaaaaagggtttgaaatatagctgttctttatgcataaaanacccagctaggaccantactgccagagaaaaanatygtattgaatggccatttccctacntawaagatgtctcaatctgaatttatttggctacactaaagaatgcagtatatttagttttccatttgcatnatgtntntgtgctatagatnatattttaaattgaaaagtttgt

SEQ ID NO: 3898 - DNA, 744 bp, Artificial Sequence
  Description of Artificial Sequence: Synthetic polynucleotide
  modified_base (261)..(261): a, c, t, g, unknown or other
  modified_base (286)..(286): a, c, t, g, unknown or other
  modified_base (347)..(347): a, c, t, g, unknown or other
  modified_base (356)..(356): a, c, t, g, unknown or other
  modified_base (396)..(396): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctayaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacantcctcccacgacaaagttttaccytcagkaattgtgctcacaacagctttcctcctagagntttctgccnagaacatacacaggtgcctagaagactcctggcttatctnaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 3899 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttytcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaanaccttttatggctcagtgctcattc

SEQ ID NO: 3900 - DNA, 171 bp, Artificial Sequence
  Description of Artificial Sequence: Synthetic polynucleotide
  modified_base (45)..(45): a, c, t, g, unknown or other
  modified_base (130)..(130): a, c, t, g, unknown or other
  modified_base (158)..(158): a, c, t, g, unknown or other
actggtttattagtccctcctagctcaacctctaatttgttctcntggagcactgcagagaagtcaaaacacrattctgaatgacgagccctggtcattaaccctgattctcagaagttgtcatcttccngattctgcagtctctgtgcctttgcagnctgccttcctggg

SEQ ID NO: 3901 - DNA, 150 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (94)..(94): a, c, t, g, unknown or other
  modified_base (96)..(96): a, c, t, g, unknown or other
ccctygttctctgcacaccntgtgcntccataccccagcctcaggcctttctataccatttyctatttggggcacayagtttttattcaacttncntgctgtcytttgagaatctacaatgtggtttggatatggcactttttatcagga

SEQ ID NO: 3902 - DNA, 156 bp, Artificial Sequence
  Description of Artificial Sequence: Synthetic polynucleotide
  modified_base (3)..(3): a, c, t, g, unknown or other
  modified_base (9)..(9): a, c, t, g, unknown or other
  modified_base (14)..(14): a, c, t, g, unknown or other
  modified_base (16)..(16): a, c, t, g, unknown or other
  modified_base (21)..(21): a, c, t, g, unknown or other
  modified_base (47)..(47): a, c, t, g, unknown or other
  modified_base (65)..(65): a, c, t, g, unknown or other
  modified_base (121)..(121): a, c, t, g, unknown or other
  modified_base (125)..(125): a, c, t, g, unknown or other
  modified_base (128)..(128): a, c, t, g, unknown or other
  modified_base (154)..(154): a, c, t, g, unknown or other
atntattantagananagatnttagtctttcttgctgggaatcaaanaacagtgttcagtctttngtctatgtatctagatgtckaaggatgcatgtggggatgtgttatatacatttayntgtnctngtgtagcattcaaggaaaataaatantc

SEQ ID NO: 3903 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacytgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 3904 - DNA, 744 bp, Artificial Sequence
  Description of Artificial Sequence: Synthetic polynucleotide
  modified_base (58)..(58): a, c, t, g, unknown or other
  modified_base (261)..(261): a, c, t, g, unknown or other
  modified_base (286)..(286): a, c, t, g, unknown or other
  modified_base (347)..(347): a, c, t, g, unknown or other
  modified_base (396)..(396): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacantcctcccacgacaaagttttaccytcagkaattgtgctcacaacagctttcctcctagagntttctgccragaacatacacaggtgcctagaagactcctggcttatctnaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 3905 - DNA, 327 bp, Artificial Sequence
  Description of Artificial Sequence: Synthetic polynucleotide
  modified_base (121)..(121): a, c, t, g, unknown or other
  modified_base (195)..(195): a, c, t, g, unknown or other
  modified_base (245)..(245): a, c, t, g, unknown or other
  modified_base (254)..(254): a, c, t, g, unknown or other
gaatcatatgttgtccatcccccyctcaggcttgraagtcctcaaagagacccactatcccatatcactgcccagagggatgatgggagatgcagccttgatcatgtgacttccagcatgntcacctactgccttctgagtagaagaactcactgcagagcagtttacctcattktaccttagttgcatgtgatngcaatgtttgagttattacttgcagagataggagcaaaaattacaaaaanacacagggnagtgggtccttttgtggytttcctagttactcaaattgactttcccccacctttgcacaggtgctttcaatag

SEQ ID NO: 3906 - DNA, 221 bp, Artificial Sequence
  Description of Artificial Sequence: Synthetic polynucleotide
  modified_base (2)..(2): a, c, t, g, unknown or other
  modified_base (63)..(63): a, c, t, g, unknown or other
  modified_base (67)..(67): a, c, t, g, unknown or other
  modified_base (103)..(103): a, c, t, g, unknown or other
  modified_base (121)..(121): a, c, t, g, unknown or other
  modified_base (131)..(131): a, c, t, g, unknown or other
  modified_base (136)..(136): a, c, t, g, unknown or other
  modified_base (155)..(155): a, c, t, g, unknown or other
  modified_base (178)..(178): a, c, t, g, unknown or other
  modified_base (186)..(186): a, c, t, g, unknown or other
  modified_base (206)..(206): a, c, t, g, unknown or other
gntgaggacagaagggactctaggaatttcagaagactrtaactggggagttttgggggaaanaatntattctttgctgactaaccattggttaggtggtggncagggcaggycatagggnaagctttgangggangggctcaaaaatcagtcantgtaggctatgttatacagtgtnccctgctnaggcctcaataagaagaatngtggaaagttctcta

SEQ ID NO: 3907 - DNA, 656 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (171)..(171): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (348)..(348): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  misc_feature (510)..(513): This region may encompass 'tact' or is absent in its entirety
  modified_base (553)..(553): a, c, t, g, unknown or other
  modified_base (577)..(577): a, c, t, g, unknown or other
  modified_base (580)..(580): a, c, t, g, unknown or other
  modified_base (618)..(618): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatnaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgntttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagacccttactatcatatctagcttttaacctaccagttatgcacctagcntcaaaaacaccatttcctccgagnttnacaagcctactgaaatcaccatagttctttagtaagcntcagaagcctggagtatggatgtatatttttctcctgt

SEQ ID NO: 3908 - DNA, 196 bp, Artificial Sequence
  Description of Artificial Sequence: Synthetic polynucleotide
  modified_base (6)..(6): a, c, t, g, unknown or other
  modified_base (24)..(24): a, c, t, g, unknown or other
  modified_base (63)..(63): a, c, t, g, unknown or other
  modified_base (66)..(66): a, c, t, g, unknown or other
  modified_base (76)..(76): a, c, t, g, unknown or other
  modified_base (78)..(78): a, c, t, g, unknown or other
  modified_base (80)..(80): a, c, t, g, unknown or other
  modified_base (84)..(84): a, c, t, g, unknown or other
  modified_base (90)..(90): a, c, t, g, unknown or other
  modified_base (102)..(102): a, c, t, g, unknown or other
  modified_base (123)..(123): a, c, t, g, unknown or other
  modified_base (125)..(125): a, c, t, g, unknown or other
  modified_base (129)..(129): a, c, t, g, unknown or other
  modified_base (133)..(133): a, c, t, g, unknown or other
  modified_base (158)..(158): a, c, t, g, unknown or other
  modified_base (163)..(163): a, c, t, g, unknown or other
  modified_base (174)..(174): a, c, t, g, unknown or other
  modified_base (178)..(178): a, c, t, g, unknown or other
  modified_base (190)..(190): a, c, t, g, unknown or other
attaantaatcacatttccaacantgcatcaagcatctgagaataacatyattttgagtaaancanaaactcttcngnanagancccctncccacaggtcangctgctcaaatgtccaccatntntagnagcnagagagatggagctcagaggcaacntcctnttcccttgaantccngatcagcctttnaggtgc

SEQ ID NO: 3909 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcrttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3910 - DNA, 122 bp, Artificial Sequence
  Description of Artificial Sequence: Synthetic polynucleotide
  modified_base (2)..(2): a, c, t, g, unknown or other
  misc_feature (34)..(36): This region may encompass 'aac' or 'gtg'
  modified_base (38)..(38): a, c, t, g, unknown or other
  modified_base (54)..(54): a, c, t, g, unknown or other
  modified_base (69)..(69): a, c, t, g, unknown or other
  modified_base (73)..(73): a, c, t, g, unknown or other
  modified_base (77)..(77): a, c, t, g, unknown or other
  modified_base (104)..(104): a, c, t, g, unknown or other
cngaagataaaataacagtccactttataaaccrwsangtgaaacattaacaancaaaggaaaagttgntgantctntgctagatgttgtggttgaaaataatntagatattgatggbtttg

SEQ ID NO: 3911 - DNA, 120 bp, Artificial Sequence
  Description of Artificial Sequence: Synthetic polynucleotide
  modified_base (49)..(49): a, c, t, g, unknown or other
  modified_base (71)..(71): a, c, t, g, unknown or other
  modified_base (73)..(73): a, c, t, g, unknown or other
  modified_base (75)..(75): a, c, t, g, unknown or other
  modified_base (80)..(80): a, c, t, g, unknown or other
  modified_base (113)..(113): a, c, t, g, unknown or other
  modified_base (119)..(119): a, c, t, g, unknown or other
tggtgtatttccaatatgttttcttgctttttgtcagtttcaaatawanagaatgtgaaaaataaacaagncngnaactnacttcaagttttaagagtgataaagtattgtgnaagttna

SEQ ID NO: 3912 - DNA, 610 bp, Artificial Sequence
  Description of Artificial Sequence: Synthetic polynucleotide
  modified_base (44)..(44): a, c, t, g, unknown or other
  modified_base (160)..(160): a, c, t, g, unknown or other
  modified_base (227)..(227): a, c, t, g, unknown or other
  modified_base (319)..(319): a, c, t, g, unknown or other
  misc_feature (350)..(350): May or may not be present
  modified_base (356)..(356): a, c, t, g, unknown or other
  modified_base (496)..(526): a, c, t, g, unknown or other
  modified_base (543)..(543): a, c, t, g, unknown or other
  modified_base (592)..(592): a, c, t, g, unknown or other
  modified_base (602)..(602): a, c, t, g, unknown or other
tatttactttggtaccaattctagatatayatctgcatataccnggtatttaacttcctggtctcatgttccttaaatagttaataagaaagagtaattatgaaccatgcagascaattaacaagcctaacttccaatattttcttcactctgaartaantatttccaacaktgtattatgtcagaagttctcrgttttgggggtgctgtatcttaatttttctgtnctctaktttcaacttcactgamataatacaagctctatcttccttacaaatttataaggaatcaaatgaaatgaaatatataaaagttgtcntctttctcccatcttcaaaaaacttccccctgcaytncatttcctgttarccctctctccttcaacagcctggtctgtagaaagagtccatacatggcctccctccactscctcatcttccattcaytccttgttccaaggycctcccaacaccactgaaacttttttcaatgcccnnnnnnnnnnnnnnnnnnnnnnnnnnnnnnngcaaattctgcccccancttttcattctttcagttgaaccactttttccaaaacactgtgcagatntaaaaaatangtagttaa

SEQ ID NO: 3913 - DNA, 867 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (261)..(261): a, c, t, g, unknown or other
  modified_base (280)..(280): a, c, t, g, unknown or other
  modified_base (297)..(297): a, c, t, g, unknown or other
  modified_base (326)..(326): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  modified_base (376)..(376): a, c, t, g, unknown or other
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  misc_feature (583)..(584): This region may encompass 'ga' or 'ag'
  modified_base (618)..(618): a, c, t, g, unknown or other
  modified_base (649)..(649): a, c, t, g, unknown or other
  modified_base (674)..(674): a, c, t, g, unknown or other
  modified_base (698)..(698): a, c, t, g, unknown or other
  modified_base (712)..(712): a, c, t, g, unknown or other
  modified_base (717)..(717): a, c, t, g, unknown or other
  modified_base (734)..(734): a, c, t, g, unknown or other
  modified_base (799)..(799): a, c, t, g, unknown or other
  modified_base (801)..(801): a, c, t, g, unknown or other
  modified_base (815)..(815): a, c, t, g, unknown or other
  modified_base (829)..(829): a, c, t, g, unknown or other
  modified_base (838)..(838): a, c, t, g, unknown or other
  modified_base (855)..(855): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactngangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacrrattcctctatttcacagagtaagattatggaagnarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 3914 - DNA, 412 bp, Artificial Sequence
  Description of Artificial Sequence: Synthetic polynucleotide
  modified_base (116)..(116): a, c, t, g, unknown or other
  modified_base (181)..(181): a, c, t, g, unknown or other
  modified_base (197)..(197): a, c, t, g, unknown or other
  modified_base (248)..(248): a, c, t, g, unknown or other
  modified_base (260)..(260): a, c, t, g, unknown or other
  modified_base (295)..(295): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcngccccaaggtcactcnaaatgccacctccttcagttactctctyctttgttcaatgcctcctttatnacactgtctgcnttatgcctagccctgggtatgttatttctcttacnacctgaatagkggggaggctcttccaagggaagaccagtttcctccatgntgtggaanggtcaacacacagkaggtnctccaatatttarctgttccngctgttctgtgctccttgg

SEQ ID NO: 3915 - DNA, 224 bp, Artificial Sequence
  Description of Artificial Sequence: Synthetic polynucleotide
  modified_base (15)..(15): a, c, t, g, unknown or other
  modified_base (34)..(34): a, c, t, g, unknown or other
  modified_base (44)..(44): a, c, t, g, unknown or other
  modified_base (49)..(49): a, c, t, g, unknown or other
  modified_base (58)..(58): a, c, t, g, unknown or other
  modified_base (63)..(63): a, c, t, g, unknown or other
  modified_base (65)..(65): a, c, t, g, unknown or other
  modified_base (71)..(71): a, c, t, g, unknown or other
  modified_base (105)..(105): a, c, t, g, unknown or other
  modified_base (110)..(110): a, c, t, g, unknown or other
  modified_base (114)..(114): a, c, t, g, unknown or other
  modified_base (122)..(122): a, c, t, g, unknown or other
  modified_base (125)..(125): a, c, t, g, unknown or other
  modified_base (155)..(155): a, c, t, g, unknown or other
  modified_base (161)..(161): a, c, t, g, unknown or other
  modified_base (165)..(165): a, c, t, g, unknown or other
  modified_base (172)..(172): a, c, t, g, unknown or other
  modified_base (179)..(179): a, c, t, g, unknown or other
  modified_base (195)..(195): a, c, t, g, unknown or other
  modified_base (197)..(197): a, c, t, g, unknown or other
ctttctraaggtgantgcagacagacatggtccngcatctttgnatacnagaatcaantcagnanctcacngacactarttatcagcttgtgtttattcacatcncaganaagngyttaatnacntaatacatattggtcaattctttrcttttnaacttnaccntttgccnatcagcngatcaatatgtatttnantcttctgttttagaastgattttaaga

SEQ ID NO: 3916 - DNA, 886 bp, Artificial Sequence
  Description of Artificial Sequence: Synthetic polynucleotide
  modified_base (77)..(77): a, c, t, g, unknown or other
  modified_base (85)..(85): a, c, t, g, unknown or other
  modified_base (117)..(153): a, c, t, g, unknown or other
  modified_base (263)..(263): a, c, t, g, unknown or other
  modified_base (365)..(365): a, c, t, g, unknown or other
  modified_base (391)..(391): a, c, t, g, unknown or other
  modified_base (399)..(422): a, c, t, g, unknown or other
  modified_base (441)..(441): a, c, t, g, unknown or other
  modified_base (461)..(461): a, c, t, g, unknown or other
  modified_base (466)..(466): a, c, t, g, unknown or other
  modified_base (574)..(574): a, c, t, g, unknown or other
  modified_base (603)..(603): a, c, t, g, unknown or other
  modified_base (627)..(627): a, c, t, g, unknown or other
  modified_base (666)..(666): a, c, t, g, unknown or other
  modified_base (676)..(676): a, c, t, g, unknown or other
  modified_base (684)..(684): a, c, t, g, unknown or other
  modified_base (695)..(695): a, c, t, g, unknown or other
  modified_base (739)..(739): a, c, t, g, unknown or other
  modified_base (752)..(752): a, c, t, g, unknown or other
  modified_base (756)..(756): a, c, t, g, unknown or other
gtgcactgtcacttgagaatttcaaattatatgataagtagctaaggcagtcaaagaaaggctttggagatgaccanaaagtacnttatgtaactaagttattcagtccctaaaccnnnnnnnnnnnnnnnnnnnnnnnnnnnnnnnnnnnnngatacaggaaaaaagagcttgtcaaaaaatctcaaaagaataaagtctattggatttaaaccatttccttataaaacctgattrctgtattacagatatgaactctatangcactcaaatcctttcatcaataaaaggcaataagactcttattgagtaacaataagaggcaataaggctcttattgactgtaacattatttaggatagttntttccaatagaaatatcaagaccaangggttacnnnnnnnnnnnnnnnnnnnnnnnngtcagtactataccatcanctctgcaaggtaactgctcngaaanagagcctgaggaatcttttctgatcacagatcttttggttttcccttgcccagttcgacttctttgccgcaccataaatccaccaatacctatccaaaaaagaaattnggtaaactgataartaatttctccctacntttccacagtacacaggataaaantgctttatcttgaatagtaagtcattttccaaaattaantctgtgctantctaaatnaataacctganttttaggtaaaatagaagttaaaaacraccaaaaaaaaaaaaangrcaaagccactnttancacttatcaaacagaatacaaaaagacctgtgtgcacttcctcttctcaacagtatcagtgtaaatatcaaacactaaattacgctggcttatctatttgacaaatattagtgcctcatacatcacataa

SEQ ID NO: 3917 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataarttacaacttgctgaaanaccttttatggctcagtgctcattc

SEQ ID NO: 3918 - DNA, 170 bp, Artificial Sequence
  Description of Artificial Sequence: Synthetic polynucleotide
  modified_base (35)..(35): a, c, t, g, unknown or other
  modified_base (39)..(39): a, c, t, g, unknown or other
  modified_base (77)..(77): a, c, t, g, unknown or other
  modified_base (105)..(105): a, c, t, g, unknown or other
  modified_base (117)..(117): a, c, t, g, unknown or other
cccatttttattaattattgaatctggttggattnccanataatgtcttttcatactgctttgcaatacttcagacntacttgtatggaatctgaacattaatgnttcccatcaggntgaaagaataaagggamtaagatagtacactcttgaattacaagctaagtctt

SEQ ID NO: 3919 - DNA, 210 bp, Artificial Sequence
  Description of Artificial Sequence: Synthetic polynucleotide
  modified_base (19)..(19): a, c, t, g, unknown or other
  modified_base (24)..(24): a, c, t, g, unknown or other
  modified_base (65)..(65): a, c, t, g, unknown or other
  modified_base (87)..(87): a, c, t, g, unknown or other
  modified_base (93)..(93): a, c, t, g, unknown or other
  modified_base (121)..(121): a, c, t, g, unknown or other
  modified_base (139)..(139): a, c, t, g, unknown or other
  modified_base (143)..(143): a, c, t, g, unknown or other
  modified_base (147)..(147): a, c, t, g, unknown or other
  modified_base (160)..(160): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
atatcctgtttgtgacagnataancattgtaatggaaaagattatgatgcactggcctgwtctangacttcactgcattcatcagcncagganacaaagacatgcacttttttcataattnttttagtaataattgacnattngagnaaatgaatggcanrnaanaattangggcagacaagatggtcagcaaatcaaactgggaaatgc

SEQ ID NO: 3920 - DNA, 309 bp, Artificial Sequence
  Description of Artificial Sequence: Synthetic polynucleotide
  modified_base (3)..(3): a, c, t, g, unknown or other
  modified_base (32)..(32): a, c, t, g, unknown or other
  modified_base (63)..(63): a, c, t, g, unknown or other
  modified_base (70)..(70): a, c, t, g, unknown or other
  modified_base (85)..(85): a, c, t, g, unknown or other
  modified_base (98)..(98): a, c, t, g, unknown or other
  modified_base (116)..(116): a, c, t, g, unknown or other
  modified_base (118)..(118): a, c, t, g, unknown or other
  modified_base (130)..(130): a, c, t, g, unknown or other
  modified_base (143)..(143): a, c, t, g, unknown or other
  misc_feature (209)..(210): This region may encompass 'ca' or 'tg'
  modified_base (285)..(285): a, c, t, g, unknown or other
atntgtgttgaaaagacctatttttccctaantggcagtgaaacatcattaaatatatgtacncatatancacacacacaatatngcatgtacacttnacacacgtccatgcatgngnactgagagagcntgggcaagtcagnaagacccttatctgaaggacatacccttggtgccatttgggagaacaaactcctgttactagcatyrcaacaaaaacaggtggcaagctttaaagataaactcaagacagcgagtgaaacttcagcaaatacgtgttaatangaccatgagtraaaggcccttcct

SEQ ID NO: 3921 - DNA, 400 bp, Artificial Sequence
  Description of Artificial Sequence: Synthetic polynucleotide
  modified_base (90)..(90): a, c, t, g, unknown or other
  modified_base (139)..(139): a, c, t, g, unknown or other
  modified_base (205)..(205): a, c, t, g, unknown or other
  modified_base (215)..(215): a, c, t, g, unknown or other
attgacacggaaaggcaaaaagactttctggattatgaaaaaacatgatatccaacaaatcttgattgcccatgtaaatcttgattgycnatgtaatgtttagtttgtattctttaagccatgtcataagtatatctcntcattgtagtcacacagtttgtcatatcattcttgaaatacttccttctcattygagtcatattcntcaacataantccagggtttactccagtttttccacagtatggttgcctagcaaagcgactataccatcttatttgaggttccttgtgttctgaggccactggagcaatttatgtggaattaaatttctttagtaaagaacaaatatgatcaactggtcgtaaaaaaggctattagtgtgggagtmaacttcttt

SEQ ID NO: 3922 - DNA, 337 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (21)..(21): a, c, t, g, unknown or other
  modified_base (39)..(39): a, c, t, g, unknown or other
  modified_base (44)..(44): a, c, t, g, unknown or other
  modified_base (58)..(58): a, c, t, g, unknown or other
  modified_base (88)..(88): a, c, t, g, unknown or other
  modified_base (99)..(99): a, c, t, g, unknown or other
  modified_base (117)..(117): a, c, t, g, unknown or other
  modified_base (147)..(147): a, c, t, g, unknown or other
  modified_base (191)..(191): a, c, t, g, unknown or other
  modified_base (216)..(216): a, c, t, g, unknown or other
  modified_base (230)..(230): a, c, t, g, unknown or other
  modified_base (263)..(263): a, c, t, g, unknown or other
  modified_base (302)..(302): a, c, t, g, unknown or other
ttctntctcatgcctntctgnctrtgtccacagtgtctnaattnaaggtccttggtcntcaaggaaccaagactacactgagatccantcttgggaagngcctctccttcaacctcnggtaccactcatccataaacaccaacactntttgcctctttgtgtatcataaagtccctcattgaaacagcccnttaaactccagtctggaaaacaaanccactgggctacantaagraccaattttagacacagacatcctcccncttcctcttgaccccaggtattctctgccaaactacaantcctccaggaaatcagcatctagcagcacccccac

SEQ ID NO: 3923 - DNA, 1051 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  misc_feature (493)..(496): This region may encompass 'tttt' or is absent in its entirety
  modified_base (597)..(597): a, c, t, g, unknown or other
  modified_base (604)..(604): a, c, t, g, unknown or other
  modified_base (606)..(606): a, c, t, g, unknown or other
  modified_base (643)..(643): a, c, t, g, unknown or other
  modified_base (683)..(683): a, c, t, g, unknown or other
  modified_base (687)..(687): a, c, t, g, unknown or other
  modified_base (714)..(714): a, c, t, g, unknown or other
  modified_base (728)..(728): a, c, t, g, unknown or other
  modified_base (755)..(755): a, c, t, g, unknown or other
  modified_base (791)..(791): a, c, t, g, unknown or other
  modified_base (994)..(994): a, c, t, g, unknown or other
  modified_base (997)..(997): a, c, t, g, unknown or other
  modified_base (1008)..(1008): a, c, t, g, unknown or other
  modified_base (1026)..(1026): a, c, t, g, unknown or other
  modified_base (1032)..(1032): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttttttcttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 3924 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagrgagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 3925 - DNA, 690 bp, Artificial Sequence
  Description of Artificial Sequence: Synthetic polynucleotide
  modified_base (7)..(7): a, c, t, g, unknown or other
  modified_base (12)..(12): a, c, t, g, unknown or other
  modified_base (20)..(20): a, c, t, g, unknown or other
  modified_base (34)..(34): a, c, t, g, unknown or other
  modified_base (40)..(40): a, c, t, g, unknown or other
  modified_base (46)..(46): a, c, t, g, unknown or other
  modified_base (53)..(53): a, c, t, g, unknown or other
  modified_base (61)..(61): a, c, t, g, unknown or other
  modified_base (66)..(66): a, c, t, g, unknown or other
  modified_base (119)..(119): a, c, t, g, unknown or other
  modified_base (140)..(140): a, c, t, g, unknown or other
  modified_base (154)..(154): a, c, t, g, unknown or other
  modified_base (174)..(174): a, c, t, g, unknown or other
  modified_base (176)..(176): a, c, t, g, unknown or other
  modified_base (190)..(190): a, c, t, g, unknown or other
  modified_base (218)..(218): a, c, t, g, unknown or other
  modified_base (223)..(223): a, c, t, g, unknown or other
  modified_base (242)..(242): a, c, t, g, unknown or other
  modified_base (244)..(244): a, c, t, g, unknown or other
  modified_base (259)..(259): a, c, t, g, unknown or other
  modified_base (267)..(267): a, c, t, g, unknown or other
  modified_base (276)..(276): a, c, t, g, unknown or other
  modified_base (284)..(284): a, c, t, g, unknown or other
  modified_base (289)..(289): a, c, t, g, unknown or other
  modified_base (318)..(318): a, c, t, g, unknown or other
  modified_base (329)..(329): a, c, t, g, unknown or other
  modified_base (362)..(362): a, c, t, g, unknown or other
  modified_base (372)..(372): a, c, t, g, unknown or other
  modified_base (386)..(386): a, c, t, g, unknown or other
  modified_base (394)..(394): a, c, t, g, unknown or other
  modified_base (401)..(401): a, c, t, g, unknown or other
  modified_base (409)..(409): a, c, t, g, unknown or other
  modified_base (449)..(449): a, c, t, g, unknown or other
  modified_base (456)..(456): a, c, t, g, unknown or other
  modified_base (483)..(483): a, c, t, g, unknown or other
  modified_base (540)..(540): a, c, t, g, unknown or other
  modified_base (547)..(547): a, c, t, g, unknown or other
  modified_base (553)..(553): a, c, t, g, unknown or other
  modified_base (580)..(580): a, c, t, g, unknown or other
  modified_base (616)..(616): a, c, t, g, unknown or other
  modified_base (620)..(620): a, c, t, g, unknown or other
  modified_base (683)..(683): a, c, t, g, unknown or other
tgatgcnaacangcatcatntctggccactgaanccaggntcttangtttaancataaaangcttngtctcatgggctgcaaaccaccaasatagaactaagattgataagaaaaatanactgtttactcaaaacaggtntataccagcctacntatttataatgtcctattananggttgtacagttcntatcctcaataattcagtaggtatcycnctaanatctatttgaaatcccccnanaataacatttagcantagcttcntgatctctntagaatgntgtcnttatttttcttaaacatttgatatgttanaccacccaggnggaaaatagaacacagagtgtaggatacacacntactcaccanaaaaacaaccatantgtaacancaaaatntatttatnaattggtcaaggaaattgaatttaacatatgctgttatcntacaagnatttttaatgaaataacatyttgtatntatatagcacctttctactaaggagcaaaaatatggctcagayattattactcattntcacacnatcctngacaggtggataagtagyaacatttanaccaagttttaatcactgggaaacaaagacatgcanaaanagagcaaataaaccacaaatggtaacccagaaagttggcattttccaccccccaatgcccacngtggtcc

SEQ ID NO: 3926 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctwaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 3927 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  modified_base (89)..(89): a, c, t, g, unknown or other
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (226)..(226): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctacttncaagttctttccccaaacttttctcacctatgtttncctatggggctntngaytcagnttcatgngcaatgtgttcctataaagaagaaggagtgtagggycaccttcngcttatgttttagctctagaggatgagngaagagccaacgtgtgycagtttgaggatggatgtacagtgagtagtgaggggctttttccaccttgaanrcatgagngctcttgagnccctcccactgnanttcagagtcaccagatntgtgcatgatatctctgc

SEQ ID NO: 3928 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattasacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3929 - DNA, 174 bp, Artificial Sequence
  Description of Artificial Sequence: Synthetic polynucleotide
  modified_base (25)..(25): a, c, t, g, unknown or other
  modified_base (32)..(32): a, c, t, g, unknown or other
  modified_base (37)..(37): a, c, t, g, unknown or other
  modified_base (45)..(45): a, c, t, g, unknown or other
  modified_base (50)..(50): a, c, t, g, unknown or other
  modified_base (55)..(55): a, c, t, g, unknown or other
  modified_base (62)..(62): a, c, t, g, unknown or other
  modified_base (97)..(97): a, c, t, g, unknown or other
  modified_base (105)..(105): a, c, t, g, unknown or other
  modified_base (120)..(120): a, c, t, g, unknown or other
  modified_base (144)..(144): a, c, t, g, unknown or other
tgttttcagctctttttatattgtncatagtnttttnatgtaatntactngcatntgttttngtagactgtttaatgactggatatcttcctycaanttttgaantacaaaacyagtgtnttttacttgtacactgttttaaantctattaaaattgtcatttgacttttttct

SEQ ID NO: 3930 - DNA, 100 bp, Artificial Sequence
  Description of Artificial Sequence: Synthetic polynucleotide
  modified_base (10)..(10): a, c, t, g, unknown or other
  modified_base (41)..(41): a, c, t, g, unknown or other
  modified_base (50)..(50): a, c, t, g, unknown or other
  modified_base (57)..(57): a, c, t, g, unknown or other
  modified_base (85)..(85): a, c, t, g, unknown or other
  modified_base (91)..(91): a, c, t, g, unknown or other
  modified_base (93)..(93): a, c, t, g, unknown or other
ttcgaattcngctgaagctcaagcaagcaaggcagagaaanggctaatcngacccanggygagatcccaccacctactccttcgncgcacngngattcaa

SEQ ID NO: 3931 - DNA, 149 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (45)..(45): a, c, t, g, unknown or other
  modified_base (51)..(51): a, c, t, g, unknown or other
  modified_base (71)..(71): a, c, t, g, unknown or other
  modified_base (106)..(106): a, c, t, g, unknown or other
  modified_base (117)..(117): a, c, t, g, unknown or other
gatgaagnynacgttatttgctccactttccactgactggaatcntcttanctcatctctgtagatgcctnaatrtcaccaacttctttcttcaagrcagcctccncatcatcatcntctccctcacttccagagggctgctgatcctt

SEQ ID NO: 3932 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1028)..(1028): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1729)..(1729): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcytctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 3933 - DNA, 343 bp, Artificial Sequence
  Description of Artificial Sequence: Synthetic polynucleotide
  modified_base (10)..(39): a, c, t, g, unknown or other
  modified_base (41)..(46): a, c, t, g, unknown or other
  modified_base (52)..(52): a, c, t, g, unknown or other
  modified_base (64)..(64): a, c, t, g, unknown or other
  modified_base (66)..(66): a, c, t, g, unknown or other
  modified_base (79)..(79): a, c, t, g, unknown or other
  modified_base (109)..(109): a, c, t, g, unknown or other
  modified_base (144)..(144): a, c, t, g, unknown or other
  modified_base (200)..(200): a, c, t, g, unknown or other
  modified_base (230)..(230): a, c, t, g, unknown or other
  modified_base (242)..(242): a, c, t, g, unknown or other
  modified_base (252)..(252): a, c, t, g, unknown or other
  modified_base (278)..(278): a, c, t, g, unknown or other
ataatgctgnnnnnnnnnnnnnnnnnnnnnnnnnnnnnnynnnnnngcaaantataaatataananacatatttacttntacttgtgcaaataattctataggcctgantgaaagggaatgttccacctttctacctttttttnaatgacaaatttctgataaaattccttkttacctaatgaatgacttcagtttcaanatatgctaaatgcattcagtttccagtagnctgggcacacantgtatgctanacttggtgaacttgaggactgaaagntttcttggcctgcttgtctggaaagtgcagtggttccttgcagaccttttgtcttcattattttc

SEQ ID NO: 3934 - DNA, 171 bp, Artificial Sequence
  Description of Artificial Sequence: Synthetic polynucleotide
  modified_base (25)..(25): a, c, t, g, unknown or other
  modified_base (29)..(29): a, c, t, g, unknown or other
  modified_base (39)..(39): a, c, t, g, unknown or other
  modified_base (43)..(43): a, c, t, g, unknown or other
  modified_base (67)..(67): a, c, t, g, unknown or other
  modified_base (72)..(72): a, c, t, g, unknown or other
  modified_base (74)..(74): a, c, t, g, unknown or other
  modified_base (104)..(104): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (150)..(150): a, c, t, g, unknown or other
  modified_base (156)..(156): a, c, t, g, unknown or other
  modified_base (158)..(158): a, c, t, g, unknown or other
  modified_base (163)..(163): a, c, t, g, unknown or other
aaatgttttcactgccaaagttagngtanatttgctagnttanccatggtcagtaatagtttgtacnttttntnttgtagyctgaaaatgtaactctaaccccnaggcctgaaacctggtgggaanatgatnganaagtgttttagattnaacagntnactangtatgact

SEQ ID NO: 3935 - DNA, 301 bp, Artificial Sequence
  Description of Artificial Sequence: Synthetic polynucleotide
  modified_base (37)..(37): a, c, t, g, unknown or other
  modified_base (51)..(51): a, c, t, g, unknown or other
  modified_base (75)..(75): a, c, t, g, unknown or other
  modified_base (119)..(119): a, c, t, g, unknown or other
  modified_base (124)..(124): a, c, t, g, unknown or other
  modified_base (129)..(129): a, c, t, g, unknown or other
  modified_base (141)..(141): a, c, t, g, unknown or other
  modified_base (166)..(166): a, c, t, g, unknown or other
  modified_base (168)..(168): a, c, t, g, unknown or other
  modified_base (206)..(206): a, c, t, g, unknown or other
  modified_base (245)..(245): a, c, t, g, unknown or other
  modified_base (250)..(250): a, c, t, g, unknown or other
  modified_base (270)..(270): a, c, t, g, unknown or other
  modified_base (280)..(280): a, c, t, g, unknown or other
  modified_base (297)..(297): a, c, t, g, unknown or other
tgattgmttcaacataaatactatggyttatttctanatggcaaggaaaantcacrtgtaagaggtttccwtttnaaagaattccactattcatcaaaattttcatctattctcaagantgttnatttnaaactaggtttngagtagcaaagcatatgaattttanantagaaracatgagaaggatataaaagtttgttttctgnattctttcaaaattcttattttgaaggccttctgggcanataanctattggaacttgtcatcanttaaactatntcctataaagatgarantcag

SEQ ID NO: 3936 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccyttctattctcaccacccatgtttctttgtttccttctagcctgtgtaataatctcataatckyanctcctgtacctgccttctttctagtccagaatacnttttcctaaattccncnaataaccatcctgctactgctttgtgtgaaattctccaaaaaaaattttacttttccaaaataagtcangctccctctcttaggatncaaaaccacaccatggtcccagccaatctttcagcctg

SEQ ID NO: 3937 - DNA, 505 bp, Artificial Sequence
  Description of Artificial Sequence: Synthetic polynucleotide
  modified_base (12)..(12): a, c, t, g, unknown or other
  modified_base (44)..(44): a, c, t, g, unknown or other
  modified_base (85)..(85): a, c, t, g, unknown or other
  modified_base (121)..(121): a, c, t, g, unknown or other
  modified_base (136)..(136): a, c, t, g, unknown or other
  modified_base (170)..(170): a, c, t, g, unknown or other
  modified_base (179)..(179): a, c, t, g, unknown or other
  modified_base (197)..(197): a, c, t, g, unknown or other
  modified_base (252)..(252): a, c, t, g, unknown or other
  modified_base (278)..(278): a, c, t, g, unknown or other
  modified_base (307)..(307): a, c, t, g, unknown or other
  modified_base (426)..(426): a, c, t, g, unknown or other
  modified_base (483)..(483): a, c, t, g, unknown or other
  modified_base (487)..(487): a, c, t, g, unknown or other
  modified_base (496)..(496): a, c, t, g, unknown or other
ccttaaatggtntatcaactaaatggtttatttgaatcaataangaaaattcctagacagcattttttcttttyacttttattcntcattaaaaagacasggagtaagaaaaggaaaaaangyaacatgttataanatattttcccatattaatccaagaacacaataanaacaacaanaaactcagtgagaactcntattaccaattttaagaatgagtctgaggaattttcaaracttttatttaatagnttgaaataatctgtcaaaatgtatcnataaaacamaacagaatgaacaaaatttngagattaaagttgtatcataaaaaaataccaagaagttaaatattccacagttcatttaattaattatccagtatttattctgtaccaactatagcaatggttttaggctacgtgctcnaataaataagtattrtaaggctccccatgctccaaatttgtttttaatcttcaccantctntttttagtnttaggcaac

SEQ ID NO: 3938 - DNA, 866 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (261)..(261): a, c, t, g, unknown or other
  modified_base (280)..(280): a, c, t, g, unknown or other
  modified_base (297)..(297): a, c, t, g, unknown or other
  modified_base (326)..(326): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  modified_base (376)..(376): a, c, t, g, unknown or other
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  modified_base (583)..(583): a, c, t, g, unknown or other
  modified_base (617)..(617): a, c, t, g, unknown or other
  modified_base (648)..(648): a, c, t, g, unknown or other
  modified_base (673)..(673): a, c, t, g, unknown or other
  modified_base (697)..(697): a, c, t, g, unknown or other
  modified_base (711)..(711): a, c, t, g, unknown or other
  modified_base (716)..(716): a, c, t, g, unknown or other
  modified_base (798)..(798): a, c, t, g, unknown or other
  modified_base (800)..(800): a, c, t, g, unknown or other
  modified_base (814)..(814): a, c, t, g, unknown or other
  modified_base (828)..(828): a, c, t, g, unknown or other
  modified_base (837)..(837): a, c, t, g, unknown or other
  modified_base (854)..(854): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactngangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaagnarcaagattttggttaaatcccttacaatgnccaggagatcttggacagaagacanttatatagcattttgttagtgcanaatttaaaagaaantgctntgactatgctctggtcytagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 3939 - DNA, 171 bp, Artificial Sequence
  Description of Artificial Sequence: Synthetic polynucleotide
  modified_base (73)..(73): a, c, t, g, unknown or other
  modified_base (130)..(130): a, c, t, g, unknown or other
  modified_base (158)..(158): a, c, t, g, unknown or other
actggtttattagtccctcctagctcaacctctaatttgttctcytggagcactgcagagaagtcaaaacacnattctgaatgacgagccctggtcattaaccctgattctcagaagttgtcatcttccngattctgcagtctctgtgcctttgcagnctgccttcctggg

SEQ ID NO: 3940 - DNA, 201 bp, Artificial Sequence
  Description of Artificial Sequence: Synthetic polynucleotide
  modified_base (11)..(11): a, c, t, g, unknown or other
  modified_base (15)..(15): a, c, t, g, unknown or other
  modified_base (32)..(32): a, c, t, g, unknown or other
  modified_base (42)..(64): a, c, t, g, unknown or other
  modified_base (79)..(79): a, c, t, g, unknown or other
  modified_base (130)..(130): a, c, t, g, unknown or other
aggaaagtaanaaangggtgaagaggagaagnttccaaaacnnnnnnnnnnnnnnnnnnnnnnngggaatcacaggagnctataaaggaactatttaaatatcatgatactccccaaagtctcagatagncaatctcatgaattgcaaaagccaattaaaaaacraacttcgttaagtgaattcatcttgctatggtagtt

SEQ ID NO: 3941 - DNA, 117 bp, Artificial Sequence
  Description of Artificial Sequence: Synthetic polynucleotide
  modified_base (32)..(32): a, c, t, g, unknown or other
  modified_base (34)..(34): a, c, t, g, unknown or other
  modified_base (42)..(42): a, c, t, g, unknown or other
  modified_base (53)..(53): a, c, t, g, unknown or other
  modified_base (107)..(107): a, c, t, g, unknown or other
  modified_base (114)..(114): a, c, t, g, unknown or other
aacttctcaaactaaattatatcaaatatatntngcattttngcaaaataaanyactaaactatwctttgtagacatattcattacatttattttaataactacttntataggntga

SEQ ID NO: 3942 - DNA, 617 bp, Artificial Sequence
  Description of Artificial Sequence: Synthetic polynucleotide
  modified_base (3)..(3): a, c, t, g, unknown or other
  modified_base (20)..(20): a, c, t, g, unknown or other
  modified_base (72)..(72): a, c, t, g, unknown or other
  modified_base (115)..(115): a, c, t, g, unknown or other
  modified_base (137)..(137): a, c, t, g, unknown or other
  modified_base (205)..(205): a, c, t, g, unknown or other
  modified_base (247)..(247): a, c, t, g, unknown or other
  modified_base (274)..(274): a, c, t, g, unknown or other
  modified_base (295)..(295): a, c, t, g, unknown or other
  modified_base (313)..(313): a, c, t, g, unknown or other
  modified_base (330)..(330): a, c, t, g, unknown or other
  modified_base (332)..(332): a, c, t, g, unknown or other
  modified_base (364)..(364): a, c, t, g, unknown or other
  modified_base (387)..(387): a, c, t, g, unknown or other
  modified_base (407)..(407): a, c, t, g, unknown or other
  modified_base (420)..(420): a, c, t, g, unknown or other
  modified_base (427)..(427): a, c, t, g, unknown or other
  modified_base (435)..(435): a, c, t, g, unknown or other
  modified_base (443)..(443): a, c, t, g, unknown or other
  modified_base (445)..(445): a, c, t, g, unknown or other
  modified_base (466)..(466): a, c, t, g, unknown or other
  modified_base (468)..(468): a, c, t, g, unknown or other
  modified_base (485)..(485): a, c, t, g, unknown or other
  modified_base (493)..(493): a, c, t, g, unknown or other
  modified_base (500)..(500): a, c, t, g, unknown or other
  modified_base (548)..(548): a, c, t, g, unknown or other
  modified_base (576)..(576): a, c, t, g, unknown or other
  modified_base (591)..(591): a, c, t, g, unknown or other
  modified_base (610)..(610): a, c, t, g, unknown or other
tcnaaacttttttgtttttnattaagcacattccacagtacaaagctgtcatgaataatayctgtacaattnaacagtttcaatagctgttcagacacaaatttatttcaaacanataattggcaaacataattaantacaagttagaattagactatcccagtgctttaaaacattaatatagcagtaatttacatttgctcanttatggttagcaaaataaagtccagagtatggctgggaattnactattataatcccagaaagtcagaantccttgggtgccaaagtcccntgctataatttagtaggnacaattcaaaggttgtntncatattcaaaggccatsatctcccaaggaacnaggggracttctatattaaacangcaaaaacaacaaaaaatcnattcattcattcngrattgnctcctccnctgccccntnccttccccctgggctttcctnancagtttgataytgaagntgtaggangaaaagnggtcaaarctaaatcactttcacaaccaccatcaagcttacaacatcnccttatgaatggaggtttattgtttacnctttgagactcaacntctcaaaaacataaattangtaacat

SEQ ID NO: 3943 - DNA, 857 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (108)..(108): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (609)..(609): a, c, t, g, unknown or other
  modified_base (660)..(660): a, c, t, g, unknown or other
  modified_base (755)..(755): a, c, t, g, unknown or other
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaanttcagaggtataacttcaacattaacaggtgaaaagttctacaatgactngttgcactcyatcacattanaataattgaactataatttccatacaacayaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatnccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 3944 - DNA, 692 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (453)..(453): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (568)..(568): a, c, t, g, unknown or other
  modified_base (584)..(584): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagsggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 3945 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttmatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 3946 - DNA, 425 bp, Artificial Sequence
  Description of Artificial Sequence: Synthetic polynucleotide
  modified_base (95)..(95): a, c, t, g, unknown or other
  modified_base (194)..(194): a, c, t, g, unknown or other
  modified_base (262)..(262): a, c, t, g, unknown or other
aaatcatttaattaatcatcaggttctttatccttasttaaaaatgtagaggcacaaaagtcatgtgtcaaaatatgctcttttttaatagagtntggtccactacccactgtgtgtcctcttaacctttccagagtaggtgtccttacagcataaatttagcataaaattagacacgttccagtataaaatanaatgaagacataataagccaatactgaattctttagtgaatctagaaaattcactttaattttttttnctagaaaatggatttattttagtgtatttatttgtttttgcatttgcctcatggttctgcatggctaacttgttaaagtcacaagatatcgtatattgggtggatttgcaagcgatgtttagtgttttcttccctgatgaaccaacataaccatcattctgct

SEQ ID NO: 3947 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccaratgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 3948 - DNA, 177 bp, Artificial Sequence
  Description of Artificial Sequence: Synthetic polynucleotide
  modified_base (46)..(46): a, c, t, g, unknown or other
  modified_base (51)..(51): a, c, t, g, unknown or other
  modified_base (56)..(56): a, c, t, g, unknown or other
  modified_base (98)..(98): a, c, t, g, unknown or other
  modified_base (147)..(171): a, c, t, g, unknown or other
atggccgggctcggttagtaagtggygtattcaacgggttcacacnatcangagcnctcytaaaatagtaacacagggtctctctcctttgctgaaantcactcagatatttaaatgtatctctatttcaggttacttctacaaccnnnnnnnnnnnnnnnnnnnnnnnnngaagag

SEQ ID NO: 3949 - DNA, 516 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  modified_base (184)..(184): a, c, t, g, unknown or other
  modified_base (215)..(215): a, c, t, g, unknown or other
  modified_base (218)..(218): a, c, t, g, unknown or other
  modified_base (243)..(243): a, c, t, g, unknown or other
  modified_base (250)..(250): a, c, t, g, unknown or other
  modified_base (258)..(258): a, c, t, g, unknown or other
  modified_base (272)..(272): a, c, t, g, unknown or other
  modified_base (274)..(274): a, c, t, g, unknown or other
  modified_base (305)..(305): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (335)..(335): a, c, t, g, unknown or other
  modified_base (403)..(403): a, c, t, g, unknown or other
  modified_base (413)..(413): a, c, t, g, unknown or other
  modified_base (441)..(441): a, c, t, g, unknown or other
  modified_base (456)..(456): a, c, t, g, unknown or other
  modified_base (458)..(458): a, c, t, g, unknown or other
  modified_base (477)..(477): a, c, t, g, unknown or other
  modified_base (480)..(480): a, c, t, g, unknown or other
  modified_base (495)..(495): a, c, t, g, unknown or other
  modified_base (500)..(500): a, c, t, g, unknown or other
  modified_base (513)..(513): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagnaagtaaaaggcatcccattagtcttttcagntcntagtcaaggacaatkatcatgaatnaatctgnttactatntacttaacacaagntntgagaagaaaagcatcatagttctgaaatgntgatngntcnctaagccacaaatgagaggnaggtttcccacctatctcagttgataatgtccaaaaacatccttcyccatgcatcagagtagaaaganaatgtacctnctactatgtcaaatggaatagataactncaaartaggaacacntnagaacattctctaacattntancagtctgatgcttcnccttntctgccacttcanara

SEQ ID NO: 3950 - DNA, 240 bp, Artificial Sequence
  Description of Artificial Sequence: Synthetic polynucleotide
  modified_base (4)..(4): a, c, t, g, unknown or other
  modified_base (11)..(11): a, c, t, g, unknown or other
  modified_base (17)..(17): a, c, t, g, unknown or other
  modified_base (28)..(28): a, c, t, g, unknown or other
  modified_base (35)..(35): a, c, t, g, unknown or other
  modified_base (38)..(38): a, c, t, g, unknown or other
  modified_base (40)..(40): a, c, t, g, unknown or other
  modified_base (44)..(44): a, c, t, g, unknown or other
  modified_base (49)..(49): a, c, t, g, unknown or other
  modified_base (59)..(59): a, c, t, g, unknown or other
  modified_base (67)..(67): a, c, t, g, unknown or other
  modified_base (71)..(71): a, c, t, g, unknown or other
  modified_base (96)..(96): a, c, t, g, unknown or other
  modified_base (99)..(99): a, c, t, g, unknown or other
  modified_base (127)..(127): a, c, t, g, unknown or other
  modified_base (130)..(130): a, c, t, g, unknown or other
  modified_base (138)..(138): a, c, t, g, unknown or other
  modified_base (172)..(172): a, c, t, g, unknown or other
  modified_base (176)..(176): a, c, t, g, unknown or other
  modified_base (179)..(179): a, c, t, g, unknown or other
  modified_base (201)..(201): a, c, t, g, unknown or other
aatnccttcanatttgngcagcatggangagaagnaanantttncaagnttggcctttnatataagntgtnytgcaggtgctgtttgatttttytnagntatttttakcccttgatcccctttgctngynagaggtgnggaactgctcactgacagcttctctgtaayctgntacnagnggatcrttcttgattttgtttntcatttctttgtcaktgaggacttttccccttacaacag

SEQ ID NO: 3951 - DNA, 96 bp, Artificial Sequence
  Description of Artificial Sequence: Synthetic oligonucleotide
  modified_base (6)..(6): a, c, t, g, unknown or other
  modified_base (53)..(53): a, c, t, g, unknown or other
  modified_base (63)..(63): a, c, t, g, unknown or other
  modified_base (69)..(69): a, c, t, g, unknown or other
  modified_base (73)..(73): a, c, t, g, unknown or other
tgtggnaaatacaccacatgtgtgaaaggcatggttcaactgttctggcytanatacaccacngctgcntcanttatccaccagcctgtaaaaaac

SEQ ID NO: 3952 - DNA, 692 bp, Artificial Sequence
  Description of Artificial Sequence: Synthetic polynucleotide
  modified_base (2)..(2): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (453)..(453): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (568)..(568): a, c, t, g, unknown or other
  modified_base (584)..(584): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcygtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 3953 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaamansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 3954 - DNA, 674 bp, Artificial Sequence
  Description of Artificial Sequence: Synthetic polynucleotide
  modified_base (29)..(29): a, c, t, g, unknown or other
  modified_base (44)..(44): a, c, t, g, unknown or other
  modified_base (61)..(61): a, c, t, g, unknown or other
  modified_base (78)..(78): a, c, t, g, unknown or other
  modified_base (84)..(84): a, c, t, g, unknown or other
  modified_base (88)..(88): a, c, t, g, unknown or other
  modified_base (170)..(170): a, c, t, g, unknown or other
  misc_feature (216)..(219): This region may encompass 'ttaa' or is absent in its entirety
  modified_base (229)..(229): a, c, t, g, unknown or other
  modified_base (232)..(232): a, c, t, g, unknown or other
  modified_base (237)..(237): a, c, t, g, unknown or other
  modified_base (261)..(261): a, c, t, g, unknown or other
  modified_base (303)..(303): a, c, t, g, unknown or other
  modified_base (366)..(433): a, c, t, g, unknown or other
  modified_base (484)..(484): a, c, t, g, unknown or other
  modified_base (506)..(506): a, c, t, g, unknown or other
  modified_base (562)..(562): a, c, t, g, unknown or other
  modified_base (642)..(642): a, c, t, g, unknown or other
  modified_base (649)..(649): a, c, t, g, unknown or other
  modified_base (660)..(660): a, c, t, g, unknown or other
  modified_base (673)..(673): a, c, t, g, unknown or other
ttgctttttcaatggggacataatcacanagatgcagatgtgtngtgcaaagaacacacangcaccagataaaataancataantgcncyttctacagacagaacacctggctttgtggaaagttagaaggccacacaatgcctcagaaaatgcataaaataaactaaanctaagcactaaattcaatactaaaaccccttcatctgggactcaattaagttaccattncgnttagnatgcaactataawaacatatgccnaaactttccaaaaacccacaatcttgaaagaaagtggtcccntgacatgcaggtatctgagttagcagttctgcttcaatgaagagaaagcaaaaaggaaaaggnnnnnnnnnnnnnnnnnnnnnnnnnnnnnnnnnnnnnnnnnnnnnnnnnnnnnnnnnnnnnnnnnnnncctccctttaaacatgaaggaacaaatgrcaaggtaagaacaaataatatnataggtttcaataaacaatatntttattcataattattacctgtctctggcattccctatccaccagtctagaaaaanatgtgacaaaaatgaaacaaaagaataaaatacatttttttctaacttgctgatagaagsttgatcattggaactctaantgcatgnaaaagtcttcnatctaatttaaana

SEQ ID NO: 3955 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncygctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 3956 - DNA, 146 bp, Artificial Sequence
  Description of Artificial Sequence: Synthetic polynucleotide
  modified_base (11)..(11): a, c, t, g, unknown or other
  modified_base (54)..(54): a, c, t, g, unknown or other
  modified_base (57)..(57): a, c, t, g, unknown or other
  modified_base (97)..(97): a, c, t, g, unknown or other
  modified_base (100)..(100): a, c, t, g, unknown or other
taactgttttncaaagtgactcatggcccaagttttggacagaaatatgytttnaanatgttacattattcagttattttgactttatgttgcaccnagnattttaatccactcaatatgaatgtggaatataataaaacaatagc

SEQ ID NO: 3957 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccaraaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3958 - DNA, 166 bp, Artificial Sequence
  Description of Artificial Sequence: Synthetic polynucleotide
  modified_base (144)..(144): a, c, t, g, unknown or other
tgagaaagacattccgggaaaccaggaggtgaggagaccaaggattaggctccactcctattatgaagatgaacagtttttagagtatcatggagttggagaaggtacttcaaggatctctatggggarcaagaaggaacagcnaagttccaccatcctgtgccct

SEQ ID NO: 3959 - DNA, 149 bp, Artificial Sequence
  Description of Artificial Sequence: Synthetic polynucleotide
  modified_base (19)..(19): a, c, t, g, unknown or other
  modified_base (42)..(42): a, c, t, g, unknown or other
  modified_base (44)..(44): a, c, t, g, unknown or other
  modified_base (73)..(73): a, c, t, g, unknown or other
  modified_base (99)..(99): a, c, t, g, unknown or other
  modified_base (108)..(108): a, c, t, g, unknown or other
  modified_base (116)..(116): a, c, t, g, unknown or other
  modified_base (120)..(120): a, c, t, g, unknown or other
tgaaagaacatggtgttgngaaaagaaagagcagttacacantngaacagttggaacaggtgtttgstcaggnaggatgggatgctcagccctgccagnctgtacttnttaacagnagtngcttgtaccaggagctggagtcagatggc

SEQ ID NO: 3960 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  misc_feature (217)..(217): May or may not be present
  modified_base (276)..(276): a, c, t, g, unknown or other
  modified_base (322)..(322): a, c, t, g, unknown or other
  modified_base (363)..(363): a, c, t, g, unknown or other
  modified_base (404)..(404): a, c, t, g, unknown or other
  modified_base (406)..(406): a, c, t, g, unknown or other
  modified_base (444)..(444): a, c, t, g, unknown or other
  modified_base (454)..(454): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaataaagaaatttaagagatttactccaccaatctcttggtaatttttgtgttcattatcantaagctgtgtgcatccttttagagtgctactgtttgagaaaagcancattgaagttgctgctgatcttggtcatgcattttcagagngtgcttatcagcagacttggatgctgttggggttctstttntnatttgcaatttttccaagacaggctttctgttgcccangctggagtgngtagctgctgtttctcaatagacaagtcctagaagtagarataattcaattttcattcactcttagctcttctgc

SEQ ID NO: 3961 - DNA, 144 bp, Artificial Sequence
  Description of Artificial Sequence: Synthetic polynucleotide
  modified_base (23)..(23): a, c, t, g, unknown or other
  modified_base (77)..(77): a, c, t, g, unknown or other
  modified_base (87)..(87): a, c, t, g, unknown or other
  modified_base (128)..(128): a, c, t, g, unknown or other
  modified_base (134)..(134): a, c, t, g, unknown or other
  modified_base (142)..(142): a, c, t, g, unknown or other
gaaaatattagcctctacattangcatgcatttagaagcttacctgaaatctrccttttatamaggaatagtatggntaagtggaantgtacattttttaaacttgattgccattaaagcagaaattntaaggntgcaacanma

SEQ ID NO: 3962 - DNA, 209 bp, Artificial Sequence
  Description of Artificial Sequence: Synthetic polynucleotide
  modified_base (18)..(18): a, c, t, g, unknown or other
  modified_base (24)..(24): a, c, t, g, unknown or other
  modified_base (32)..(32): a, c, t, g, unknown or other
  modified_base (38)..(38): a, c, t, g, unknown or other
  modified_base (64)..(64): a, c, t, g, unknown or other
  modified_base (94)..(94): a, c, t, g, unknown or other
  modified_base (101)..(101): a, c, t, g, unknown or other
  modified_base (133)..(133): a, c, t, g, unknown or other
  modified_base (141)..(141): a, c, t, g, unknown or other
  modified_base (151)..(151): a, c, t, g, unknown or other
  modified_base (182)..(182): a, c, t, g, unknown or other
  modified_base (186)..(186): a, c, t, g, unknown or other
  modified_base (188)..(188): a, c, t, g, unknown or other
ttaccaaacagaaccacnagctangaggatanaaatanttcccrtgttcactagccattaaatnaacatagccacttgtgcaggaagcctaacntttttanayttcctaactttttaaaacttaaggataagnccatttcnacaagctaantttacagctccttaatattcttmatctggangttnantttgcagactttgttggtgtc

SEQ ID NO: 3963 - DNA, 667 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (60)..(60): a, c, t, g, unknown or other
  modified_base (85)..(85): a, c, t, g, unknown or other
  modified_base (110)..(110): a, c, t, g, unknown or other
  modified_base (124)..(124): a, c, t, g, unknown or other
  modified_base (133)..(133): a, c, t, g, unknown or other
  modified_base (157)..(157): a, c, t, g, unknown or other
  modified_base (185)..(185): a, c, t, g, unknown or other
  modified_base (204)..(204): a, c, t, g, unknown or other
  modified_base (209)..(209): a, c, t, g, unknown or other
  modified_base (219)..(219): a, c, t, g, unknown or other
  modified_base (261)..(261): a, c, t, g, unknown or other
  modified_base (270)..(270): a, c, t, g, unknown or other
  modified_base (297)..(297): a, c, t, g, unknown or other
  modified_base (315)..(315): a, c, t, g, unknown or other
  modified_base (320)..(320): a, c, t, g, unknown or other
  modified_base (324)..(324): a, c, t, g, unknown or other
  modified_base (355)..(355): a, c, t, g, unknown or other
  modified_base (383)..(383): a, c, t, g, unknown or other
  modified_base (395)..(395): a, c, t, g, unknown or other
  modified_base (411)..(411): a, c, t, g, unknown or other
  modified_base (432)..(432): a, c, t, g, unknown or other
  modified_base (452)..(452): a, c, t, g, unknown or other
  modified_base (470)..(470): a, c, t, g, unknown or other
  modified_base (475)..(475): a, c, t, g, unknown or other
  modified_base (487)..(487): a, c, t, g, unknown or other
  modified_base (517)..(517): a, c, t, g, unknown or other
  modified_base (532)..(532): a, c, t, g, unknown or other
  modified_base (546)..(546): a, c, t, g, unknown or other
  modified_base (613)..(613): a, c, t, g, unknown or other
  modified_base (653)..(653): a, c, t, g, unknown or other
  modified_base (656)..(656): a, c, t, g, unknown or other
cccctcagcatggncctctgaaccagcctgacctgncctgcaggctccaacacaccagcnggccctgccagaaccttggcaaggncrggatgcatgaattccagagccangacagcccgtcaanagggccttnttatttccccttcccagggccacnactgcacagaataatgatttttgacagngaagccaaatgaatactangggangtgaccactngtactcaggagtacttatgagaaaaagaataagaacaaaaantgtttaagntacctctctattgtataatatatactnacaacaaataaaacattntgttnaacnttagaaattacattttaaaacaagattctcnttaaaaacacacacaaaccacacacacnaatgacaacaanaataaaaacactgtangaatactgcaggaagggttcnaggtaatccacatcaacccnggtatcaggttcttgagnccagnccatggctaagngcgaacacactctgtattagtgtctcaagncagggggccctgacnccagcaactttgangttaaactgttatgtacattatatctacatgygaatacagtattttaaattaggaggcaagcacacntataaaggtgttactctaccaaatatcaggagatggttgnggncagagaacagt

SEQ ID NO: 3964 - DNA, 168 bp, Artificial Sequence
  Description of Artificial Sequence: Synthetic polynucleotide
  modified_base (31)..(31): a, c, t, g, unknown or other
  modified_base (43)..(43): a, c, t, g, unknown or other
  modified_base (87)..(87): a, c, t, g, unknown or other
  modified_base (156)..(156): a, c, t, g, unknown or other
gtatctaatcaggagattttggtamgytttncaagyacacccnttyttgtgaaactgagttctaacctgaagaatacctgggattrnatggcgaaaaaacacaatatattaaaattttaaaacagttcttattttaggctcaaattttatgttttngggactacttag

SEQ ID NO: 3965 - DNA, 271 bp, Artificial Sequence
  Description of Artificial Sequence: Synthetic polynucleotide
  modified_base (4)..(4): a, c, t, g, unknown or other
  modified_base (21)..(21): a, c, t, g, unknown or other
  modified_base (25)..(25): a, c, t, g, unknown or other
  modified_base (30)..(30): a, c, t, g, unknown or other
  modified_base (34)..(34): a, c, t, g, unknown or other
  modified_base (42)..(42): a, c, t, g, unknown or other
  modified_base (47)..(47): a, c, t, g, unknown or other
  modified_base (76)..(76): a, c, t, g, unknown or other
  modified_base (91)..(91): a, c, t, g, unknown or other
  modified_base (100)..(100): a, c, t, g, unknown or other
  modified_base (110)..(110): a, c, t, g, unknown or other
  modified_base (150)..(150): a, c, t, g, unknown or other
  modified_base (152)..(152): a, c, t, g, unknown or other
  modified_base (177)..(177): a, c, t, g, unknown or other
  modified_base (187)..(187): a, c, t, g, unknown or other
  modified_base (201)..(201): a, c, t, g, unknown or other
  modified_base (214)..(214): a, c, t, g, unknown or other
  modified_base (218)..(218): a, c, t, g, unknown or other
  modified_base (266)..(266): a, c, t, g, unknown or other
aaanaggtatataccagcctnctcnggaanctgntggtggancttangactggaaactgttgaaagttaaaaayanttcccaaaccttgancatctactngacaaatttnatgtgtaccagggacaaatgaaagtatccttccaaaatangncccaaattattgtcaagcctttctntaataaaggnccattcctcaagcngctgtcacataangtgnaggtgatcaacagcaaatccattagcaacacaggataaagaaatttgnrtagc

SEQ ID NO: 3966 - DNA, 148 bp, Artificial Sequence
  Description of Artificial Sequence: Synthetic polynucleotide
  modified_base (13)..(13): a, c, t, g, unknown or other
  modified_base (16)..(16): a, c, t, g, unknown or other
  misc_feature (42)..(43): This region may encompass 'ca' or 'tg'
  modified_base (45)..(45): a, c, t, g, unknown or other
  modified_base (56)..(56): a, c, t, g, unknown or other
  modified_base (88)..(88): a, c, t, g, unknown or other
  modified_base (91)..(91): a, c, t, g, unknown or other
  modified_base (110)..(110): a, c, t, g, unknown or other
  modified_base (129)..(129): a, c, t, g, unknown or other
  modified_base (131)..(131): a, c, t, g, unknown or other
gcctggtcttccnccntcggagggtactcaggaaaggcagcyrgngggacaggaanctcgaggggtccccatcagccagaatcagcanccntgttaggaatgtagacagngtggacgcactgcaccagncnttggtgtccttggcctg

SEQ ID NO: 3967 - DNA, 235 bp, Artificial Sequence
  Description of Artificial Sequence: Synthetic polynucleotide
  modified_base (232)..(232): a, c, t, g, unknown or other
gtctatactgcactgtttcagggaaataatgtgttacaacagcatagctttaatggtccataggtcacagttttcacttttattaaagtagawgattgtacatagtgatacttgaaatattttagtttcagtttctaatatatcaaaaatcagtaggtaaaaaccaacttaaatgaagactgatatctcatttrtttttattttcatatatttgttttttgcataaacaaanttt

SEQ ID NO: 3968 - DNA, 273 bp, Artificial Sequence
  Description of Artificial Sequence: Synthetic polynucleotide
  modified_base (2)..(2): a, c, t, g, unknown or other
  modified_base (87)..(87): a, c, t, g, unknown or other
  modified_base (125)..(125): a, c, t, g, unknown or other
  modified_base (161)..(161): a, c, t, g, unknown or other
  modified_base (166)..(166): a, c, t, g, unknown or other
  modified_base (168)..(168): a, c, t, g, unknown or other
  modified_base (173)..(173): a, c, t, g, unknown or other
  modified_base (231)..(231): a, c, t, g, unknown or other
gnccattgccaaagttgtggtttttcaatttatgttkgagacaaaagagtccaaggagaattccacttgtgtaggttgcataagagngacaaacaaagctgaactggataagagtataaagaaantaagagaagcaaaatgtgtgayagaggccacagatnctgcntntaganagcragatggtgacaaggtgaaaaggggctgcaaatttattaactggctcagtycttnctgagagctctgcaccatatctcctccamacaggtgcagatt

SEQ ID NO: 3969 - DNA, 612 bp, Artificial Sequence
  Description of Artificial Sequence: Synthetic polynucleotide
  modified_base (88)..(88): a, c, t, g, unknown or other
  modified_base (104)..(104): a, c, t, g, unknown or other
  modified_base (173)..(173): a, c, t, g, unknown or other
  modified_base (176)..(176): a, c, t, g, unknown or other
  modified_base (184)..(184): a, c, t, g, unknown or other
  modified_base (215)..(215): a, c, t, g, unknown or other
  modified_base (417)..(417): a, c, t, g, unknown or other
  modified_base (488)..(488): a, c, t, g, unknown or other
  modified_base (512)..(512): a, c, t, g, unknown or other
  modified_base (556)..(556): a, c, t, g, unknown or other
tatctcctccacacaggtgcagattttgcttttagttttacaaagattagagcaaraaagaagctgcttttaaaacaagaaaaaaaancactttcagtgcaccntctcgtataatattatatcctattgtaccctgccrtggtttaggcatcactgtattctctcattgtgtnatntatatatnaagagctaaataaatgtctgtttcattgaangtaagarctaaataaatgtctgtttcattgaatagttcagctctgctttcacctcttctaattaaaccaacaccacatgccacttgctacctcctgaacaattactacttttgtgtttcttcatttatccaacaaacagctccaaagatggaacattcaactctaacataaaccctgctgcttccakgggctctgcrcccanccccttgttatgctacactgacatttagacctactagaaggtaactgkttttcatttatgtgtccttacangtcccaataagagtccctgaaganaaaaggtacattgcatacccaacatcaattacatttatcttccntcatatgcaaagcatcgtatgtttccacattcaagaagcaaactcatgagtcatca

SEQ ID NO: 3970 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatacnttttcctaaattccncnaataaccatcctgctactgctttgtgtgaaattctccaaaaaaaattttacttttccaaaataagtcangctccctctcttaggatrcaaaaccacaccatggtcccagccaatctttcagcctg

SEQ ID NO: 3971 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacytgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 3972 - DNA, 273 bp, Artificial Sequence
  Description of Artificial Sequence: Synthetic polynucleotide
  modified_base (33)..(33): a, c, t, g, unknown or other
  modified_base (103)..(103): a, c, t, g, unknown or other
  modified_base (114)..(114): a, c, t, g, unknown or other
  modified_base (122)..(122): a, c, t, g, unknown or other
  misc_feature (134)..(135): This region may encompass 'at' or 'cc'
  modified_base (160)..(160): a, c, t, g, unknown or other
  modified_base (176)..(176): a, c, t, g, unknown or other
  modified_base (206)..(206): a, c, t, g, unknown or other
  modified_base (260)..(260): a, c, t, g, unknown or other
gggacacaagtgcaggttcagggcaaggtgtgngagcacactcagtccctggcctcggagtctctctggatggcttcttgcctagggtgactgacagaggganggatgatatgnaaaggcanctgttctcctcmygacctaaccccaattcttactccangggttcatgacagccnattctgctggagactgtgtcttaaaacttnctcccctagtttctctcaagtacccctcgtgagctgtgatttcactgggctttnaactcttaggcca

SEQ ID NO: 3973 - DNA, 219 bp, Artificial Sequence
  Description of Artificial Sequence: Synthetic polynucleotide
  modified_base (40)..(40): a, c, t, g, unknown or other
  modified_base (77)..(120): a, c, t, g, unknown or other
  modified_base (134)..(134): a, c, t, g, unknown or other
  modified_base (168)..(168): a, c, t, g, unknown or other
  modified_base (170)..(170): a, c, t, g, unknown or other
  modified_base (205)..(205): a, c, t, g, unknown or other
  modified_base (211)..(211): a, c, t, g, unknown or other
acaacatactcgtatctcctgaaatcctgsgcttaaatcnaggtctcaaaggctttgttttgttttgttgtatggtnnnnnnnnnnnnnnnnnnnnnnnnnnnnnnnnnnnnnnnnnnnntctcctgaaattcncctcctcacttgacttaagctaaaagataaacgncnwcttcctttcagccacagatggtgatggataaatngaatgncattcaca

SEQ ID NO: 3974 - DNA, 653 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (348)..(348): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  modified_base (510)..(510): a, c, t, g, unknown or other
  modified_base (550)..(550): a, c, t, g, unknown or other
  modified_base (574)..(574): a, c, t, g, unknown or other
  modified_base (577)..(577): a, c, t, g, unknown or other
  modified_base (615)..(615): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatsaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgntttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagaccctnatcatatctagcttttaacctaccagttatgcacctagcntcaaaaacaccatttcctccgagnttnacaagcctactgaaatcaccatagttctttagtaagcntcagaagcctggagtatggatgtatatttttctcctgt

SEQ ID NO: 3975 - DNA, 218 bp, Artificial Sequence
  Description of Artificial Sequence: Synthetic polynucleotide
  modified_base (2)..(2): a, c, t, g, unknown or other
  modified_base (17)..(17): a, c, t, g, unknown or other
  modified_base (68)..(68): a, c, t, g, unknown or other
  modified_base (74)..(74): a, c, t, g, unknown or other
  modified_base (80)..(80): a, c, t, g, unknown or other
  modified_base (102)..(102): a, c, t, g, unknown or other
  modified_base (106)..(106): a, c, t, g, unknown or other
  modified_base (147)..(147): a, c, t, g, unknown or other
  modified_base (152)..(152): a, c, t, g, unknown or other
  modified_base (166)..(166): a, c, t, g, unknown or other
  modified_base (176)..(176): a, c, t, g, unknown or other
  modified_base (181)..(181): a, c, t, g, unknown or other
  modified_base (187)..(187): a, c, t, g, unknown or other
  modified_base (191)..(191): a, c, t, g, unknown or other
  modified_base (205)..(205): a, c, t, g, unknown or other
  modified_base (210)..(210): a, c, t, g, unknown or other
  modified_base (217)..(217): a, c, t, g, unknown or other
tnattcctaaaagcccnggcctttatgccattggctatgaagaatgtattgagaggcycctctcaccnacatgnagcaanttccctggacccagkaaaaganggcngggttgacctggaaaccctttcarcacaagcctcattacangtggnaatagaacccaccngaattatytnttgcnacctcnggantgctgaggtcaggnctctncagcagng

SEQ ID NO: 3976 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggygngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 3977 - DNA, 221 bp, Artificial Sequence
  Description of Artificial Sequence: Synthetic polynucleotide
  modified_base (2)..(2): a, c, t, g, unknown or other
  modified_base (39)..(39): a, c, t, g, unknown or other
  modified_base (63)..(63): a, c, t, g, unknown or other
  modified_base (67)..(67): a, c, t, g, unknown or other
  modified_base (121)..(121): a, c, t, g, unknown or other
  modified_base (131)..(131): a, c, t, g, unknown or other
  modified_base (136)..(136): a, c, t, g, unknown or other
  modified_base (155)..(155): a, c, t, g, unknown or other
  modified_base (178)..(178): a, c, t, g, unknown or other
  modified_base (186)..(186): a, c, t, g, unknown or other
  modified_base (206)..(206): a, c, t, g, unknown or other
gntgaggacagaagggactctaggaatttcagaagactntaactggggagttttgggggaaanaatntattctttgctgactaaccattggttaggtggtggkcagggcaggycatagggnaagctttgangggangggctcaaaaatcagtcantgtaggctatgttatacagtgtnccctgctnaggcctcaataagaagaatngtggaaagttctcta

SEQ ID NO: 3978 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccygggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 3979 - DNA, 119 bp, Artificial Sequence
  Description of Artificial Sequence: Synthetic polynucleotide
  modified_base (2)..(2): a, c, t, g, unknown or other
anttcttcataactactacaataatttaacattttatttcagattaatarctcaataaagtttacacagatggaaatttactaaacatgatacatttatatcagtatatttgtgtttgt

SEQ ID NO: 3980 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayrcacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 3981 - DNA, 144 bp, Artificial Sequence
  Description of Artificial Sequence: Synthetic polynucleotide
  modified_base (10)..(10): a, c, t, g, unknown or other
  modified_base (12)..(12): a, c, t, g, unknown or other
  modified_base (17)..(17): a, c, t, g, unknown or other
  modified_base (49)..(49): a, c, t, g, unknown or other
  modified_base (54)..(54): a, c, t, g, unknown or other
  modified_base (62)..(62): a, c, t, g, unknown or other
  modified_base (73)..(73): a, c, t, g, unknown or other
  modified_base (114)..(114): a, c, t, g, unknown or other
  modified_base (119)..(119): a, c, t, g, unknown or other
  modified_base (121)..(121): a, c, t, g, unknown or other
ttttttcttntntctantgtgcaacccacttcagtgccagcagcctacnggmanagaggccnggcaatggttngggctacagtttgctctggcatggggtactatgagaggycnagggncngcccatcataaatccaaacccat

SEQ ID NO: 3982 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttmtcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3983 - DNA, 857 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (108)..(108): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (660)..(660): a, c, t, g, unknown or other
  modified_base (755)..(755): a, c, t, g, unknown or other
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaanttcagaggtataacttcaacattaacaggtgaaaagttctacaatgactngttgcactcyatcacattanaataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttamttttggacagtaacaccctcagatggtatttttattggtttgttttatatnccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 3984 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  misc_feature (596)..(596): May or may not be present
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaataccttttatggctcagtgctcattc

SEQ ID NO: 3985 - DNA, 640 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (44)..(44): a, c, t, g, unknown or other
  modified_base (49)..(49): a, c, t, g, unknown or other
  modified_base (63)..(63): a, c, t, g, unknown or other
  modified_base (84)..(84): a, c, t, g, unknown or other
  modified_base (99)..(99): a, c, t, g, unknown or other
  modified_base (107)..(107): a, c, t, g, unknown or other
  modified_base (184)..(184): a, c, t, g, unknown or other
  modified_base (196)..(196): a, c, t, g, unknown or other
  modified_base (215)..(215): a, c, t, g, unknown or other
  modified_base (231)..(231): a, c, t, g, unknown or other
  modified_base (235)..(235): a, c, t, g, unknown or other
  modified_base (245)..(245): a, c, t, g, unknown or other
  modified_base (248)..(248): a, c, t, g, unknown or other
  modified_base (333)..(333): a, c, t, g, unknown or other
  modified_base (347)..(347): a, c, t, g, unknown or other
  modified_base (354)..(354): a, c, t, g, unknown or other
  modified_base (372)..(372): a, c, t, g, unknown or other
  modified_base (376)..(376): a, c, t, g, unknown or other
  modified_base (382)..(382): a, c, t, g, unknown or other
  modified_base (387)..(387): a, c, t, g, unknown or other
  modified_base (432)..(432): a, c, t, g, unknown or other
  modified_base (445)..(445): a, c, t, g, unknown or other
  modified_base (451)..(451): a, c, t, g, unknown or other
  modified_base (460)..(460): a, c, t, g, unknown or other
  modified_base (481)..(481): a, c, t, g, unknown or other
  modified_base (490)..(490): a, c, t, g, unknown or other
  modified_base (506)..(506): a, c, t, g, unknown or other
  modified_base (511)..(511): a, c, t, g, unknown or other
  modified_base (522)..(543): a, c, t, g, unknown or other
  modified_base (548)..(548): a, c, t, g, unknown or other
  modified_base (558)..(558): a, c, t, g, unknown or other
  modified_base (591)..(591): a, c, t, g, unknown or other
  modified_base (613)..(613): a, c, t, g, unknown or other
  modified_base (618)..(618): a, c, t, g, unknown or other
  modified_base (632)..(632): a, c, t, g, unknown or other
cataacttaaagtngatttattttcagtgccttttnaaagttancaaynatctttggatactntagttgccctgagttcaactncatgttttataaaanaggcacantcttcctttatgggaggaggagtttctttctatgtctttggttatyagaattagaaaaactgccttgatcagcatanattaaatttttnaaagttaastttttcaycncttgtgagactaattntatntattcttcantgntgatgattatgatgtgacttcaatttacccttcctaatgtgattgtaamttttcatgtaatgaaagaagaggcacaaccaagatnactgcacagcattngtaacangtagaaaatatatttcanattntgagangaganaaactcttagctctcaaggtcacagaatgctgacagttaattggncttttgagaaatncttganagaagactnaaaattgcattcaagtattantcaagattntgtataatagcaatanaaaancacaatgtggnnnnnnnnnnnnnnnnnnnnnngtttnctacaaatcnttgctacatacaagaaagtgtgatgtagactantaatttatgcttrgaattgctnytttnttaactacctgtcnataaaggt

SEQ ID NO: 3986 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (176)..(176): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgngtaggtgtttggcacccaaaatttcactgaagaagaatgctgtttcttartatcaaaccaaagtgcaaagcaatataaattagaggccaagncttctcttgncgntcnatttacttctgtaaaacagattctatgttccttttctatgancantttacatttgaaacattagattttttcactnatgagggaaggaaangggcttctgtnctacttnaagncngngaagctaaggtctccttctcaaagnagagcnggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 3987 - DNA, 276 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (18)..(18): a, c, t, g, unknown or other
  modified_base (31)..(31): a, c, t, g, unknown or other
  modified_base (53)..(53): a, c, t, g, unknown or other
  modified_base (61)..(61): a, c, t, g, unknown or other
  modified_base (96)..(96): a, c, t, g, unknown or other
  modified_base (100)..(100): a, c, t, g, unknown or other
  modified_base (119)..(119): a, c, t, g, unknown or other
  modified_base (150)..(150): a, c, t, g, unknown or other
  modified_base (153)..(153): a, c, t, g, unknown or other
  modified_base (157)..(157): a, c, t, g, unknown or other
  modified_base (168)..(168): a, c, t, g, unknown or other
  modified_base (179)..(179): a, c, t, g, unknown or other
  modified_base (188)..(188): a, c, t, g, unknown or other
  modified_base (190)..(190): a, c, t, g, unknown or other
  modified_base (199)..(199): a, c, t, g, unknown or other
  modified_base (215)..(215): a, c, t, g, unknown or other
  modified_base (250)..(250): a, c, t, g, unknown or other
  modified_base (252)..(252): a, c, t, g, unknown or other
  modified_base (260)..(260): a, c, t, g, unknown or other
  modified_base (268)..(268): a, c, t, g, unknown or other
ctcaggatncctganacnatttarggtgggnatgtgrgaagctggcttcaggntcagaccngaagacaagtagctgacctgggggttgagccaggnctcncacctaggcccttctccwnggggstttaccaaaaccagccccatgtcctntangayntgacttttgtnaacacacacanatatcctcncntatgcacangtgtttatgtaaaagnaatgtatgtttatatgccaaggtgacttaaaaatnanaaagtryngtacaaanatgttatt

SEQ ID NO: 3988 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtaraaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 3989 - DNA, 440 bp, Artificial Sequence
  Description of Artificial Sequence: Synthetic polynucleotide
  misc_feature (117)..(117): May or may not be present
  modified_base (294)..(294): a, c, t, g, unknown or other
  modified_base (414)..(414): a, c, t, g, unknown or other
  modified_base (437)..(437): a, c, t, g, unknown or other
gcaatggtgaatrtgatgaccacagatttttccccagccctgttctaggcagagactgggaaatgggtcattcctgtcccctattcyaattctctccttctataatggcttatttttcctttttaatgttctaacctaatgtygagcaatttcagttgattttttcataagctggaaggtccatgaaatctstttctatggccattrttttctcaaacactgcagtgtcttttttcagtgttttccatatataatgatattcctaggaatatctccttggccttcctatctaanttcacccaatgtggtgttcttcatatttcaagtraattcaatactgccttcataattgttggcmcctttaaacttttattgtccctgataggtagrtgctcatcttattggttaaatgantttyggcaatttcvctttttaantta

SEQ ID NO: 3990 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcrgaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 3991 - DNA, 744 bp, Artificial Sequence
  Description of Artificial Sequence: Synthetic polynucleotide
  modified_base (58)..(58): a, c, t, g, unknown or other
  modified_base (286)..(286): a, c, t, g, unknown or other
  modified_base (347)..(347): a, c, t, g, unknown or other
  modified_base (356)..(356): a, c, t, g, unknown or other
  modified_base (396)..(396): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatamccactaaaaattgatctggctacantcctcccacgacaaagttttaccytcagkaattgtgctcacaacagctttcctcctagagntttctgccnagaacatacacaggtgcctagaagactcctggcttatctnaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 3992 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatamtggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 3993 - DNA, 1996 bp, Artificial Sequence
  Description of Artificial Sequence: Synthetic polynucleotide
  modified_base (8)..(8): a, c, t, g, unknown or other
  modified_base (118)..(118): a, c, t, g, unknown or other
  modified_base (381)..(381): a, c, t, g, unknown or other
  modified_base (412)..(468): a, c, t, g, unknown or other
  modified_base (617)..(617): a, c, t, g, unknown or other
  modified_base (1265)..(1265): a, c, t, g, unknown or other
  modified_base (1335)..(1335): a, c, t, g, unknown or other
  modified_base (1386)..(1386): a, c, t, g, unknown or other
  modified_base (1533)..(1533): a, c, t, g, unknown or other
  modified_base (1707)..(1707): a, c, t, g, unknown or other
  modified_base (1709)..(1709): a, c, t, g, unknown or other
  modified_base (1750)..(1750): a, c, t, g, unknown or other
  modified_base (1884)..(1884): a, c, t, g, unknown or other
  modified_base (1974)..(1974): a, c, t, g, unknown or other
ataagccnctgtttataagcatggctcactcttactggctgaagagattgayttctcttgcctgccgctcttcatagcctccataaggaatgtttcaggatgtgattatgctgggganttagacacacataagggragacttttgcagagycctgccatagcatcaaaaaacaagatataacaaaaccaggaggcacmgggactagaatgcaggaggctcatcaccttttgtttcccrgyccagttcccacccaggagtactcaaaactctgcccagattcaaaatgcaaaattaaacagaccatatattaacagttgtatatatattttgcacatgaagaaaatcattatagtattacaattgtgtgtgtatatatatangycataatttttcaaatgcttggaaatgacnnnnnnnnnnnnnnnnnnnnnnnnnnnnnnnnnnnnnnnnnnnnnnnnnnnnnnnnnctatgataggggatgtggcatcttgaaggcctagttgggctgcgtgtgccattaaratatacmgggctgcagaaaagtaaaccccaaatagaatattcctttatcccttgaatgttggaaggataattagatcagatatgatcacgttnaattgatcagattggagccagtgctaactcaatcaacttccaattcctaaggcagcagaaagcccagctggagagggaaasttctgctctatctcaccctccctcattcatcctgggagccacaytgtgttctgtagaatttgctcaggattcacaatctgagctgataaacttacctggattatcryaacccttaccattttggtattttctttttgtttctcagtttaaaatgggttgtgaatattactaaygcatcataagttttcagacacccagtatgtcacttgtytgggtccmgtcctaggaaatcaatacctaaattcaaaaartcatcctaagattaatctttgaaagctgcctgtgatgattyggactcactgacctcccttctcttcaacctacagagaaagygaaagagctaccaagtctkagggcacatggacagaaccagaagatgcccagtgaagtgctaggatagggtacagtcccatagctttygggccaaatgagaaggaaaagcagaacctgggaccaggaaagccccagcagctccagactccaggrctctttaccaagactgatgggaggaactaaggcaaagatgagacacctgtcaccaagacacytgtcttggctgcttccacntctgactcagttgtgttgktgtgaatgcaaaactggctctctggctcccaagaatgtataaatccagganagaaaaccaagcatttgggcaccaggcaagaggtctttccagattccccangacttttcagaattccccaaagatactgaaactcagacccattctgaccccaccccaaaaagtatcataaatggaatctgggagccattcagagtctccagcctcctctttggtgaaaatggacttggacctaaaaaggcaccccantgtccacaaggacacaaattcagatgctgagcactggcctcctgccttccgatgacggatcttacctgagtcccatcaaagcccatactgttccccaayctccaccatccagacattaggaacaatccctcagaactgtcttgatgagatgggacaagcagtggtagargtccngnttcagaatggttgcctcatctttcccttctgagaagtctanaccygctggtctgagccttcatcccttacatggcttagcccatgtcccaggaagtgccccctaaaagaaccttctagtatttttctcccctgaagagagggtccatgagacactctatgccaggaaatacatgncctccattctcacatgacttgattgactgataaactgataccctgagaaagaaaaagatgcagggaacatcttgtgtgtggtgaatctgngctcctcagctgtggtgcctgt

SEQ ID NO: 3994 - DNA, 255 bp, Artificial Sequence
  Description of Artificial Sequence: Synthetic polynucleotide
  modified_base (100)..(100): a, c, t, g, unknown or other
  modified_base (107)..(107): a, c, t, g, unknown or other
  modified_base (152)..(152): a, c, t, g, unknown or other
  modified_base (163)..(163): a, c, t, g, unknown or other
  modified_base (227)..(227): a, c, t, g, unknown or other
  modified_base (247)..(247): a, c, t, g, unknown or other
atttagtctaccaaactacaattagtgttgttttcatttttgtwctctatatgcatgttgccatttttacacttcttcagaaaaacattgagaatttttntacactnactatttccatttgtgcctaaggacaactttttctttttcttctntttttttttgnaagaaattygtttatgaacttagataaaatttatagctttgcttgaaaatttggtacttactanctttgcaattctctttattnattattac

SEQ ID NO: 3995 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccataygagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 3996 - DNA, 162 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (27)..(27): a, c, t, g, unknown or other
  modified_base (96)..(96): a, c, t, g, unknown or other
  modified_base (99)..(99): a, c, t, g, unknown or other
  modified_base (101)..(101): a, c, t, g, unknown or other
  modified_base (125)..(125): a, c, t, g, unknown or other
  modified_base (130)..(130): a, c, t, g, unknown or other
anctacatcgtyatcntggcctgggcnacakactacctgttccagtccttccagaaggagctgcccwgggcacactgcaaccacagctggaacacnccncnctgcatggaggacaccatgcgcangaacnagagtgtctggatcaccatcagctccaccaac

SEQ ID NO: 3997 - DNA, 325 bp, Artificial Sequence
  Description of Artificial Sequence: Synthetic polynucleotide
  modified_base (58)..(58): a, c, t, g, unknown or other
  modified_base (64)..(64): a, c, t, g, unknown or other
  modified_base (66)..(66): a, c, t, g, unknown or other
  misc_feature (86)..(89): This region may encompass 'aaag' or is absent in its entirety
  modified_base (118)..(118): a, c, t, g, unknown or other
  modified_base (132)..(132): a, c, t, g, unknown or other
  modified_base (148)..(148): a, c, t, g, unknown or other
  modified_base (150)..(150): a, c, t, g, unknown or other
  modified_base (158)..(158): a, c, t, g, unknown or other
  modified_base (182)..(182): a, c, t, g, unknown or other
  modified_base (220)..(220): a, c, t, g, unknown or other
  modified_base (244)..(244): a, c, t, g, unknown or other
  modified_base (268)..(268): a, c, t, g, unknown or other
  modified_base (273)..(273): a, c, t, g, unknown or other
  modified_base (285)..(285): a, c, t, g, unknown or other
tgactggcctctcttttacctatctggttttgaattacattggctaacttcagaaaantcatcntnactaaattgtctctgaaagaaagtaattgaggcagaagatatatgcagtycntcagcaattgtttnagctgcactgtcagtntngaaataancagcctaataagaggtcagatacntggrktttaaaagcctatttatcatacagtattcaaancctttaatcattttataagcctcncmttaaatgtcagttgtcattctntttcncatcatgattanttaacaaaccaaaataccattatgttgttccttttctaga

SEQ ID NO: 3998 - DNA, 142 bp, Artificial Sequence
  Description of Artificial Sequence: Synthetic polynucleotide
  modified_base (8)..(8): a, c, t, g, unknown or other
  modified_base (23)..(23): a, c, t, g, unknown or other
  modified_base (33)..(33): a, c, t, g, unknown or other
  modified_base (58)..(58): a, c, t, g, unknown or other
  modified_base (107)..(107): a, c, t, g, unknown or other
  modified_base (131)..(131): a, c, t, g, unknown or other
acaattanaggacaaaacaaganaatttcaaanagtgatgaagattataaagaaaatnaaaccaattactgtgctagagaatgacttgagagaggtacttkggttanatgtttgcaactgcaattaaatsnatgatagtaca

SEQ ID NO: 3999 - DNA, 653 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (171)..(171): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (348)..(348): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  modified_base (510)..(510): a, c, t, g, unknown or other
  modified_base (550)..(550): a, c, t, g, unknown or other
  modified_base (577)..(577): a, c, t, g, unknown or other
  modified_base (615)..(615): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatnaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgntttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagaccctnatcatatctagcttttaacctaccagttatgcacctagcntcaaaaacaccatttcctccgagrttnacaagcctactgaaatcaccatagttctttagtaagcntcagaagcctggagtatggatgtatatttttctcctgt

SEQ ID NO: 4000 - DNA, 857 bp, Artificial Sequence
  Description of Artificial Sequence: Synthetic polynucleotide
  modified_base (5)..(5): a, c, t, g, unknown or other
  modified_base (88)..(88): a, c, t, g, unknown or other
  modified_base (108)..(108): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (609)..(609): a, c, t, g, unknown or other
  modified_base (660)..(660): a, c, t, g, unknown or other
  modified_base (755)..(755): a, c, t, g, unknown or other
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaarttcagaggtataacttcaacattaacaggtgaaaagttctacaatgactngttgcactcyatcacattanaataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatnccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 4001 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttartaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatacnttttcctaaattccncnaataaccatcctgctactgctttgtgtgaaattctccaaaaaaaattttacttttccaaaataagtcangctccctctcttaggatncaaaaccacaccatggtcccagccaatctttcagcctg

SEQ ID NO: 4002 - DNA, 175 bp, Artificial Sequence
  Description of Artificial Sequence: Synthetic polynucleotide
  modified_base (10)..(10): a, c, t, g, unknown or other
  modified_base (25)..(25): a, c, t, g, unknown or other
  misc_feature (145)..(145): May or may not be present
rygttttacncttaaaaagctttcntttcacccaatataataatgggcattattttctatgcttaaggactgaagtattacagcaattgtagtaaaaaagtaaaacattatacagctcakgtggaaacagctttctaatttttttaagactaagattaggatgcaaatccaaccc

SEQ ID NO: 4003 - DNA, 209 bp, Artificial Sequence
  Description of Artificial Sequence: Synthetic polynucleotide
  modified_base (18)..(18): a, c, t, g, unknown or other
  modified_base (24)..(24): a, c, t, g, unknown or other
  modified_base (32)..(32): a, c, t, g, unknown or other
  modified_base (38)..(38): a, c, t, g, unknown or other
  modified_base (64)..(64): a, c, t, g, unknown or other
  modified_base (94)..(94): a, c, t, g, unknown or other
  modified_base (101)..(101): a, c, t, g, unknown or other
  modified_base (103)..(103): a, c, t, g, unknown or other
  modified_base (133)..(133): a, c, t, g, unknown or other
  modified_base (141)..(141): a, c, t, g, unknown or other
  modified_base (182)..(182): a, c, t, g, unknown or other
  modified_base (186)..(186): a, c, t, g, unknown or other
  modified_base (188)..(188): a, c, t, g, unknown or other
ttaccaaacagaaccacnagctangaggatanaaatanttcccrtgttcactagccattaaatnaacatagccacttgtgcaggaagcctaacntttttananttcctaactttttaaaacttaaggataagnccatttcnacaagctaaytttacagctccttaatattcttmatctggangttnantttgcagactttgttggtgtc

SEQ ID NO: 4004 - DNA, 149 bp, Artificial Sequence
  Description of Artificial Sequence: Synthetic polynucleotide
  modified_base (2)..(2): a, c, t, g, unknown or other
  modified_base (21)..(21): a, c, t, g, unknown or other
  modified_base (58)..(58): a, c, t, g, unknown or other
  modified_base (66)..(66): a, c, t, g, unknown or other
  modified_base (69)..(69): a, c, t, g, unknown or other
  modified_base (90)..(90): a, c, t, g, unknown or other
  modified_base (100)..(100): a, c, t, g, unknown or other
  modified_base (148)..(148): a, c, t, g, unknown or other
anaaatcacatacacacacantgatccccacaccgttctcaatgcaaaggacaaatcngagcccanggnccttccctttagtagtagagntgcttccacnggaagaggtttamtttataggaggctgtttattggtcctttaaaatgnt

SEQ ID NO: 4005 - DNA, 299 bp, Artificial Sequence
  Description of Artificial Sequence: Synthetic polynucleotide
  modified_base (19)..(19): a, c, t, g, unknown or other
  modified_base (32)..(32): a, c, t, g, unknown or other
  modified_base (40)..(40): a, c, t, g, unknown or other
  modified_base (44)..(44): a, c, t, g, unknown or other
  modified_base (52)..(52): a, c, t, g, unknown or other
  modified_base (125)..(125): a, c, t, g, unknown or other
  modified_base (131)..(131): a, c, t, g, unknown or other
  modified_base (143)..(143): a, c, t, g, unknown or other
  modified_base (150)..(150): a, c, t, g, unknown or other
  modified_base (153)..(153): a, c, t, g, unknown or other
  modified_base (164)..(164): a, c, t, g, unknown or other
  modified_base (176)..(176): a, c, t, g, unknown or other
  modified_base (181)..(181): a, c, t, g, unknown or other
  modified_base (186)..(186): a, c, t, g, unknown or other
  modified_base (197)..(197): a, c, t, g, unknown or other
  modified_base (215)..(215): a, c, t, g, unknown or other
  modified_base (221)..(221): a, c, t, g, unknown or other
  modified_base (229)..(229): a, c, t, g, unknown or other
  modified_base (231)..(231): a, c, t, g, unknown or other
  modified_base (247)..(247): a, c, t, g, unknown or other
  modified_base (263)..(263): a, c, t, g, unknown or other
  modified_base (298)..(298): a, c, t, g, unknown or other
acaatttgctagaagcatnacagagcttactnacattttnaagnaaaaacancaaagaaagaartcatcaaacaagatggtatcttgacaaaggcacagmgctccacaactgcttcatactctgncacaanaaatcctctcangagaganganaggagtgatgncaaatgggcttncattngascngtggacactancactggtattattcatanaaccanggctctanancacccctctggagaanaaagtgcaacacaaantctgtgtaacaaaggaaagcaaaagtagcaataang

SEQ ID NO: 4006 - DNA, 398 bp, Artificial Sequence
  Description of Artificial Sequence: Synthetic polynucleotide
  modified_base (5)..(5): a, c, t, g, unknown or other
  modified_base (30)..(30): a, c, t, g, unknown or other
  modified_base (42)..(42): a, c, t, g, unknown or other
  modified_base (55)..(55): a, c, t, g, unknown or other
  modified_base (57)..(57): a, c, t, g, unknown or other
  modified_base (77)..(77): a, c, t, g, unknown or other
  modified_base (94)..(94): a, c, t, g, unknown or other
  modified_base (97)..(97): a, c, t, g, unknown or other
  modified_base (99)..(99): a, c, t, g, unknown or other
  modified_base (170)..(170): a, c, t, g, unknown or other
  modified_base (180)..(180): a, c, t, g, unknown or other
  modified_base (187)..(187): a, c, t, g, unknown or other
  modified_base (202)..(202): a, c, t, g, unknown or other
  modified_base (206)..(206): a, c, t, g, unknown or other
  modified_base (226)..(226): a, c, t, g, unknown or other
  modified_base (232)..(232): a, c, t, g, unknown or other
  modified_base (234)..(234): a, c, t, g, unknown or other
  modified_base (247)..(247): a, c, t, g, unknown or other
  modified_base (274)..(274): a, c, t, g, unknown or other
  modified_base (327)..(327): a, c, t, g, unknown or other
  modified_base (334)..(334): a, c, t, g, unknown or other
  modified_base (342)..(342): a, c, t, g, unknown or other
  modified_base (350)..(350): a, c, t, g, unknown or other
  modified_base (367)..(367): a, c, t, g, unknown or other
  modified_base (374)..(374): a, c, t, g, unknown or other
  modified_base (391)..(391): a, c, t, g, unknown or other
tcccncaaatccatctacatcaaatttgtngaagtagagagngattttctttccncnggctctttagttgagtgccngaaaaagccaytggatnccncntaaaatttaacaactgaakgtcatccttcataaggatttgggctcttagctccttcttctctactcacttnccattacccngaccacncctcatccagatgcngccntcagactcttcatggaaacnctttcntnattgggccagtangacttctaaggaatcatagtagacttnggccagaaaaaacagacctcacctgaaaatgctcattttgagcaagcaagatntatagcnaacttgcntggtgggncagctatttcttttttnaaaacanaaaaacaatttttaaanggatttt

SEQ ID NO: 4007 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatwtttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4008 - DNA, 424 bp, Artificial Sequence
  Description of Artificial Sequence: Synthetic polynucleotide
  modified_base (172)..(172): a, c, t, g, unknown or other
  modified_base (204)..(204): a, c, t, g, unknown or other
  modified_base (216)..(216): a, c, t, g, unknown or other
  modified_base (268)..(268): a, c, t, g, unknown or other
  modified_base (306)..(306): a, c, t, g, unknown or other
taataatacttctatggtttcttgcagctctcccaaaatacatttacatacataaaagctcattcacatacatgcacacacacacattatcacagctcttcccctctccccaacaattcattccagatgccattagatggtgctaagtgtggcaggtgattgccccgggaancacagcaagatgagaaggtttaggaggagcangagaagttgccnagggcctgggcagacagaggcagatgaggggcaggcaaggtggtaacagccnaccaaagagtgtcccatgtgagtaaaggacatgggctnagcagcaggaggctcaatggtggcactagtacacaagataaatactgggtaaatgatgaaataaatcartaggyygagaatatctgggtggcatggttctatgaaagcattgtaaata

SEQ ID NO: 4009 - DNA, 156 bp, Artificial Sequence
  Description of Artificial Sequence: Synthetic polynucleotide
  modified_base (3)..(3): a, c, t, g, unknown or other
  modified_base (9)..(9): a, c, t, g, unknown or other
  modified_base (14)..(14): a, c, t, g, unknown or other
  modified_base (16)..(16): a, c, t, g, unknown or other
  modified_base (21)..(21): a, c, t, g, unknown or other
  modified_base (65)..(65): a, c, t, g, unknown or other
  modified_base (85)..(85): a, c, t, g, unknown or other
  modified_base (121)..(121): a, c, t, g, unknown or other
  modified_base (125)..(125): a, c, t, g, unknown or other
  modified_base (128)..(128): a, c, t, g, unknown or other
  modified_base (154)..(154): a, c, t, g, unknown or other
atntattantagananagatnttagtctttcttgctgggaatcaaaraacagtgttcagtctttngtctatgtatctagatgtcnaaggatgcatgtggggatgtgttatatacatttayntgtnctngtgtagcattcaaggaaaataaatantc

SEQ ID NO: 4010 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  modified_base (217)..(217): a, c, t, g, unknown or other
  modified_base (276)..(276): a, c, t, g, unknown or other
  modified_base (322)..(322): a, c, t, g, unknown or other
  modified_base (363)..(363): a, c, t, g, unknown or other
  modified_base (404)..(404): a, c, t, g, unknown or other
  modified_base (406)..(406): a, c, t, g, unknown or other
  modified_base (454)..(454): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaanaaagaaatttaagagatttactccaccaatctcttggtaatttttgtgttcattatcantaagctgtgtgcatccttttagagtgctactgtttgagaaaagcancattgaagttgctgctgatcttggtcatgcattttcagagngtgcttatcagcagacttggatgctgttggggttctstttntnatttgcaatttttccaagacaggctttctgttgcccargctggagtgngtagctgctgtttctcaatagacaagtcctagaagtagarataattcaattttcattcactcttagctcttctgc

SEQ ID NO: 4011 - DNA, 435 bp, Artificial Sequence
  Description of Artificial Sequence: Synthetic polynucleotide
  modified_base (22)..(22): a, c, t, g, unknown or other
  modified_base (65)..(70): a, c, t, g, unknown or other
  modified_base (72)..(103): a, c, t, g, unknown or other
  modified_base (134)..(134): a, c, t, g, unknown or other
  modified_base (180)..(180): a, c, t, g, unknown or other
  modified_base (257)..(257): a, c, t, g, unknown or other
  modified_base (347)..(347): a, c, t, g, unknown or other
  modified_base (373)..(373): a, c, t, g, unknown or other
ttttaaaattatgcttaaaaanttttttattcaagctaraatttgaatatagmtaaatatcttcnnnnnnynnnnnnnnnnnnnnnnnnnnnnnnnnnnnnnnctaagagatttgcttgccaataggagcygcntaagagtgtactcaagaagaaaataacattttcctgtatamaggtnaaaattaaaatgaaggggtgagagacagaccttgagaatacaaaatcatagtggacattgaactgaggaaagcacanagttcttggcaccaaaaaattaaaagatattgagatattataaaagtacaattcacatgttttatttaaatcagaaagaaaattrtgtgnttttgtataatttaattgattacaangaaataatttttagaaaattttatcaccaacttgttaaaaatagatggcacttccattgaaa

SEQ ID NO: 4012 - DNA, 327 bp, Artificial Sequence
  Description of Artificial Sequence: Synthetic polynucleotide
  modified_base (3)..(3): a, c, t, g, unknown or other
  modified_base (10)..(10): a, c, t, g, unknown or other
  modified_base (14)..(14): a, c, t, g, unknown or other
  modified_base (17)..(17): a, c, t, g, unknown or other
  modified_base (24)..(24): a, c, t, g, unknown or other
  modified_base (74)..(74): a, c, t, g, unknown or other
  modified_base (93)..(93): a, c, t, g, unknown or other
  modified_base (107)..(107): a, c, t, g, unknown or other
  modified_base (120)..(155): a, c, t, g, unknown or other
  misc_feature (206)..(209): This region may encompass 'acaa' or is absent in its entirety
tanttttttnaaantgntaaaganaaaaagtattaaatgacataactaaatattctagacatcattctaccatnwgttgtccaagaaaaaccncattttaccttacngtttatcatttgnnnnnnnnnnnnnnnnnnnnnnnnnnnnnnnnnnnnccagttccacaaaggaactrggaagtagaaactgaagaacactttgttaaacaagtccttggggattaaagaagtaatagctacgaagtatacaacagtgtgaygagtgaatccttctcatattggggttaaaatggtcattatagctactgmgtaccacaaatccaatcaa

SEQ ID NO: 4013 - DNA, 258 bp, Artificial Sequence
  Description of Artificial Sequence: Synthetic polynucleotide
  modified_base (5)..(5): a, c, t, g, unknown or other
  modified_base (39)..(39): a, c, t, g, unknown or other
  modified_base (229)..(255): a, c, t, g, unknown or other
tgagntcttgctgcttctgttacaagagtgcttcaaacnaccattcaactgatagaatmtattggaccttgttagagtccctcaccccattcttgcaacagttcccagaaaagaagaggaatgtgsttttcagagacttatgtctctactggagcycccttgatggcagggtaaggtgggagagcatggaggaagcctctcaagaagtgagacacatgcactttctagnnnnnnnnnnnnnnnnnnnnnnnnnnnttt

SEQ ID NO: 4014 - DNA, 275 bp, Artificial Sequence
  Description of Artificial Sequence: Synthetic polynucleotide
  modified_base (9)..(9): a, c, t, g, unknown or other
  modified_base (79)..(79): a, c, t, g, unknown or other
  modified_base (147)..(147): a, c, t, g, unknown or other
  modified_base (247)..(247): a, c, t, g, unknown or other
tcaggaagnttgaaaagtatttatattttttgatacttacttctctttctgctttctctttttcatattgatctatacnttcttttaaatggttaccataattgaatacctcctcatttttctcktttagatgacgttgcattttcntctcaggaaactgaatattaattgttaccttgcttttgttaactttcttatgtgcataaactaattgctgtcgaagccacctatttttgctttctagttnaaataatttctgctccagagactcctgc

SEQ ID NO: 4015 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctasccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4016 - DNA, 120 bp, Artificial Sequence
  Description of Artificial Sequence: Synthetic polynucleotide
  modified_base (2)..(2): a, c, t, g, unknown or other
  modified_base (34)..(34): a, c, t, g, unknown or other
  modified_base (36)..(36): a, c, t, g, unknown or other
  modified_base (52)..(52): a, c, t, g, unknown or other
  modified_base (67)..(67): a, c, t, g, unknown or other
  modified_base (71)..(71): a, c, t, g, unknown or other
  modified_base (102)..(102): a, c, t, g, unknown or other
cngaagataaaataacagtccactttataaaccnangtgaaacattaacaancaaaggaaaagttgntgantctytgctagatgttgtggttgaaaataatntagatattgatggbtttg

SEQ ID NO: 4017 - DNA, 150 bp, Artificial Sequence
  Description of Artificial Sequence: Synthetic polynucleotide
  modified_base (61)..(61): a, c, t, g, unknown or other
aattaaaaaggattgtattgccatacattacaagtgattcaacacagagcctgraaaaaanaccatttttatttgaaatagtgaaattcctaacaacatagttacactcatttgcaccaagctgtgtatttgatcatggtaagcatagac

SEQ ID NO: 4018 - DNA, 463 bp, Artificial Sequence
  Description of Artificial Sequence: Synthetic polynucleotide
  modified_base (123)..(123): a, c, t, g, unknown or other
  modified_base (158)..(158): a, c, t, g, unknown or other
  modified_base (245)..(245): a, c, t, g, unknown or other
  modified_base (308)..(308): a, c, t, g, unknown or other
  modified_base (337)..(337): a, c, t, g, unknown or other
  modified_base (425)..(425): a, c, t, g, unknown or other
  modified_base (446)..(446): a, c, t, g, unknown or other
tcagacyctgactcacgctaccgcccctgccacccccagttgtttcagaagtgctgcctggggcagaggatcctggaggcctgggaagccaaygaccacacacagtaagagccactcggacanggagggacccagcctggccagtcagggatgcaganacgcacctcagccgggcactggtgatgctgcgtgcaggactgcatgctctggtggagcgctgggtgtgcgacacagctccacactcnaggctgccatgcraggggccctcctactgggtggacagctgcaaatgctacttggggaggggncacagggagctgacrggaagcagtcccanccccaccaggcacctgctctggcccctgcccagcctggcttgcctagrctttgccctcttgcgggtcccctgtccattcctgatcttnccccaagaactcgggtgctcnatcagcactcrcacatg

SEQ ID NO: 4019 - DNA, 246 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (63)..(63): a, c, t, g, unknown or other
  modified_base (72)..(72): a, c, t, g, unknown or other
  modified_base (86)..(86): a, c, t, g, unknown or other
  modified_base (106)..(106): a, c, t, g, unknown or other
  modified_base (112)..(112): a, c, t, g, unknown or other
  modified_base (146)..(146): a, c, t, g, unknown or other
  modified_base (148)..(148): a, c, t, g, unknown or other
  modified_base (150)..(150): a, c, t, g, unknown or other
  modified_base (171)..(171): a, c, t, g, unknown or other
  modified_base (201)..(201): a, c, t, g, unknown or other
  modified_base (215)..(215): a, c, t, g, unknown or other
  modified_base (224)..(224): a, c, t, g, unknown or other
  modified_base (229)..(229): a, c, t, g, unknown or other
  modified_base (233)..(233): a, c, t, g, unknown or other
atcrngcagaatantgtacagattttggaatcggtacagttgaaatgggaactttttcagagntggacaganttttcaaggctccntctttctaataaactggccntttttnggaattggttataacacccgttggaaagrggatntncnttaccattatgctgagatcanctcccaggtgccccttggcaagcgacttcnggagtacttcaacnctgagaagnctgangganggatcattatgac

SEQ ID NO: 4020 - DNA, 1743 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  misc_feature (1153)..(1154): This region may encompass 'gt' or 'ac'
  modified_base (1261)..(1261): a, c, t, g, unknown or other
  modified_base (1265)..(1265): a, c, t, g, unknown or other
  modified_base (1360)..(1360): a, c, t, g, unknown or other
  modified_base (1365)..(1365): a, c, t, g, unknown or other
  modified_base (1374)..(1374): a, c, t, g, unknown or other
  modified_base (1382)..(1382): a, c, t, g, unknown or other
  modified_base (1386)..(1386): a, c, t, g, unknown or other
  modified_base (1389)..(1389): a, c, t, g, unknown or other
  modified_base (1391)..(1391): a, c, t, g, unknown or other
  modified_base (1395)..(1395): a, c, t, g, unknown or other
  modified_base (1447)..(1447): a, c, t, g, unknown or other
  modified_base (1465)..(1465): a, c, t, g, unknown or other
  modified_base (1471)..(1471): a, c, t, g, unknown or other
  modified_base (1500)..(1500): a, c, t, g, unknown or other
  modified_base (1516)..(1516): a, c, t, g, unknown or other
  modified_base (1535)..(1535): a, c, t, g, unknown or other
  modified_base (1537)..(1537): a, c, t, g, unknown or other
  modified_base (1593)..(1593): a, c, t, g, unknown or other
  modified_base (1698)..(1698): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagrycccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4021 - DNA, 144 bp, Artificial Sequence
  Description of Artificial Sequence: Synthetic polynucleotide
  modified_base (25)..(25): a, c, t, g, unknown or other
  modified_base (32)..(32): a, c, t, g, unknown or other
  modified_base (62)..(62): a, c, t, g, unknown or other
  modified_base (64)..(64): a, c, t, g, unknown or other
  modified_base (70)..(70): a, c, t, g, unknown or other
  modified_base (74)..(74): a, c, t, g, unknown or other
  modified_base (96)..(96): a, c, t, g, unknown or other
  modified_base (101)..(101): a, c, t, g, unknown or other
  misc_feature (110)..(111): This region may encompass 'cg' or 'gc'
  modified_base (136)..(136): a, c, t, g, unknown or other
gatgccaacgtcctttccatgcacntcagggnacagtgccatttacacatttgggctgtgtntngggagnactngggagctttgagaayctgctgnggccncagcagcasstgacaccagagatgactggggtggnattcatgg

SEQ ID NO: 4022 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcakagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4023 - DNA, 424 bp, Artificial Sequence
  Description of Artificial Sequence: Synthetic polynucleotide
  modified_base (172)..(172): a, c, t, g, unknown or other
  modified_base (216)..(216): a, c, t, g, unknown or other
  modified_base (268)..(268): a, c, t, g, unknown or other
  modified_base (306)..(306): a, c, t, g, unknown or other
  modified_base (381)..(381): a, c, t, g, unknown or other
taataatacttctatggtttcttgcagctctcccaaaatacatttacatacataaaagctcattcacatacatgcacacacacacattatcacagctcttcccctctccccaacaattcattccagatgccattagatggtgctaagtgtggcaggtgattgccccgggaancacagcaagatgagaaggtttaggaggagcargagaagttgccnagggcctgggcagacagaggcagatgaggggcaggcaaggtggtaacagccnaccaaagagtgtcccatgtgagtaaaggacatgggctnagcagcaggaggctcaatggtggcactagtacacaagataaatactgggtaaatgatgaaataaatcartaggyngagaatatctgggtggcatggttctatgaaagcattgtaaata

SEQ ID NO: 4024 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (78)..(78): a, c, t, g, unknown or other
  modified_base (89)..(89): a, c, t, g, unknown or other
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (226)..(226): a, c, t, g, unknown or other
  modified_base (243)..(243): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttarctcttccagagtgttctctagtncatgctacttncaagttctttccccaaacttttctcacctatgtttncctatggggctntngaytcagnttcatgngcaatgtgttcctataaagaagaaggagtgtagggycaccttcngcttatgttttagctctagaggatgagngaagagccaacgtgtgncagtttgaggatggatgtacagtgagtagtgaggggctttttccaccttgaanrcatgagngctcttgagnccctcccactgnanttcagagtcaccagatntgtgcatgatatctctgc

SEQ ID NO: 4025 - DNA, 425 bp, Artificial Sequence
  Description of Artificial Sequence: Synthetic polynucleotide
  modified_base (37)..(37): a, c, t, g, unknown or other
  modified_base (95)..(95): a, c, t, g, unknown or other
  modified_base (262)..(262): a, c, t, g, unknown or other
aaatcatttaattaatcatcaggttctttatccttanttaaaaatgtagaggcacaaaagtcatgtgtcaaaatatgctcttttttaatagagtntggtccactacccactgtgtgtcctcttaacctttccagagtaggtgtccttacagcataaatttagcataaaattagacacgttccagtataaaatawaatgaagacataataagccaatactgaattctttagtgaatctagaaaattcactttaattttttttnctagaaaatggatttattttagtgtatttatttgtttttgcatttgcctcatggttctgcatggctaacttgttaaagtcacaagatatcgtatattgggtggatttgcaagcgatgtttagtgttttcttccctgatgaaccaacataaccatcattctgct

SEQ ID NO: 4026 - DNA, 442 bp, Artificial Sequence
  Description of Artificial Sequence: Synthetic polynucleotide
  modified_base (22)..(22): a, c, t, g, unknown or other
  modified_base (27)..(27): a, c, t, g, unknown or other
  modified_base (60)..(60): a, c, t, g, unknown or other
  modified_base (68)..(68): a, c, t, g, unknown or other
  modified_base (74)..(74): a, c, t, g, unknown or other
  modified_base (76)..(76): a, c, t, g, unknown or other
  modified_base (113)..(113): a, c, t, g, unknown or other
  modified_base (123)..(123): a, c, t, g, unknown or other
  modified_base (150)..(150): a, c, t, g, unknown or other
  modified_base (188)..(188): a, c, t, g, unknown or other
  modified_base (209)..(209): a, c, t, g, unknown or other
  modified_base (219)..(219): a, c, t, g, unknown or other
  modified_base (227)..(227): a, c, t, g, unknown or other
  modified_base (254)..(254): a, c, t, g, unknown or other
  modified_base (266)..(266): a, c, t, g, unknown or other
  modified_base (311)..(311): a, c, t, g, unknown or other
  modified_base (322)..(322): a, c, t, g, unknown or other
  modified_base (329)..(329): a, c, t, g, unknown or other
  modified_base (345)..(345): a, c, t, g, unknown or other
  modified_base (353)..(353): a, c, t, g, unknown or other
  modified_base (360)..(360): a, c, t, g, unknown or other
  modified_base (362)..(362): a, c, t, g, unknown or other
  modified_base (397)..(397): a, c, t, g, unknown or other
  modified_base (403)..(403): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (429)..(429): a, c, t, g, unknown or other
tatttgattgacaatgaaaatngtctncagtatgcaattatgacacatagattagttttnagaaagtntttggntngtatatttaatgttggacagtgcttctttaacaagtntattaaaccnctccaacaaaacttggtaaragaaagntctycttcagtttccttcctggaacttaagctcatcrnggtaggatacccagaatagangraaaattgncacttttncattgcttgactggtctgtcttacrtntatcctgatgcnggcttcaggcagamaatctctctgttactagctttgaaattttcncaagatattgnagtaatntagtgatgaagtaggncattctanagaatancngtaaggggttttcttcttcctcatagcacccatangacctnctctnctcccncacatacanaatttntacctcagttttc

SEQ ID NO: 4027 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaakggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4028 - DNA, 671 bp, Artificial Sequence
  Description of Artificial Sequence: Synthetic polynucleotide
  modified_base (29)..(29): a, c, t, g, unknown or other
  modified_base (44)..(44): a, c, t, g, unknown or other
  modified_base (61)..(61): a, c, t, g, unknown or other
  modified_base (78)..(78): a, c, t, g, unknown or other
  modified_base (84)..(84): a, c, t, g, unknown or other
  modified_base (88)..(88): a, c, t, g, unknown or other
  modified_base (170)..(170): a, c, t, g, unknown or other
  modified_base (216)..(216): a, c, t, g, unknown or other
  modified_base (226)..(226): a, c, t, g, unknown or other
  modified_base (229)..(229): a, c, t, g, unknown or other
  modified_base (234)..(234): a, c, t, g, unknown or other
  modified_base (258)..(258): a, c, t, g, unknown or other
  modified_base (300)..(300): a, c, t, g, unknown or other
  modified_base (363)..(430): a, c, t, g, unknown or other
  modified_base (481)..(481): a, c, t, g, unknown or other
  modified_base (503)..(503): a, c, t, g, unknown or other
  modified_base (639)..(639): a, c, t, g, unknown or other
  modified_base (646)..(646): a, c, t, g, unknown or other
  modified_base (657)..(657): a, c, t, g, unknown or other
  modified_base (670)..(670): a, c, t, g, unknown or other
ttgctttttcaatggggacataatcacanagatgcagatgtgtngtgcaaagaacacacangcaccagataaaataancataantgcncyttctacagacagaacacctggctttgtggaaagttagaaggccacacaatgcctcagaaaatgcataaaataaactaaanctaagcactaaattcaatactaaaaccccttcatctgggactcaangttaccattncgnttagnatgcaactataawaacatatgccnaaactttccaaaaacccacaatcttgaaagaaagtggtcccntgacatgcaggtatctgagttagcagttctgcttcaatgaagagaaagcaaaaaggaaaaggnnnnnnnnnnnnnnnnnnnnnnnnnnnnnnnnnnnnnnnnnnnnnnnnnnnnnnnnnnnnnnnnnnnncctccctttaaacatgaaggaacaaatgrcaaggtaagaacaaataatatnataggtttcaataaacaatatntttattcataattattacctgtctctggcattccctatccaccagtctagaaaaayatgtgacaaaaatgaaacaaaagaataaaatacatttttttctaacttgctgatagaagsttgatcattggaactctaantgcatgnaaaagtcttcnatctaatttaaana

SEQ ID NO: 4029 - DNA, 225 bp, Artificial Sequence
  Description of Artificial Sequence: Synthetic polynucleotide
  modified_base (22)..(22): a, c, t, g, unknown or other
aagcttaagcaaaaatgagcanttcttttaccagaacataggtgataagacataattktatgaaacatcaggtttataacaaatttattacattatgtagatattattagggctgtgaagataaaggccacataggcccatttatttgcaagtcagcacataaacatagaaggatgattaacaatataagcttctagagcttatgctaaatgttggtgggaacag

SEQ ID NO: 4030 - DNA, 279 bp, Artificial Sequence
  Description of Artificial Sequence: Synthetic polynucleotide
  modified_base (82)..(82): a, c, t, g, unknown or other
  modified_base (101)..(101): a, c, t, g, unknown or other
  modified_base (150)..(150): a, c, t, g, unknown or other
  modified_base (190)..(190): a, c, t, g, unknown or other
  modified_base (256)..(256): a, c, t, g, unknown or other
  modified_base (266)..(266): a, c, t, g, unknown or other
tttaactgattatctttttctaagccacatgktaagatgttcttgtctgtctttcagttaggactttatttttacttttaanttcagagcttcttgatggntgttctttctaaataattattatttagcaactgactgtcataagagatncaaaatacatcaaatatctaacasaaaatrtaaaatatgnagtaatcttagccctcaaggaaacccagatttcccaattctgagtatattgttcaagttccttttncaggacagcncaaggttctgtca

SEQ ID NO: 4031 - DNA, 320 bp, Artificial Sequence
  Description of Artificial Sequence: Synthetic polynucleotide
  modified_base (12)..(12): a, c, t, g, unknown or other
  modified_base (68)..(68): a, c, t, g, unknown or other
  modified_base (73)..(73): a, c, t, g, unknown or other
  modified_base (117)..(117): a, c, t, g, unknown or other
  modified_base (122)..(122): a, c, t, g, unknown or other
  modified_base (124)..(124): a, c, t, g, unknown or other
  modified_base (137)..(137): a, c, t, g, unknown or other
  modified_base (140)..(140): a, c, t, g, unknown or other
  modified_base (168)..(168): a, c, t, g, unknown or other
  modified_base (203)..(203): a, c, t, g, unknown or other
  modified_base (211)..(211): a, c, t, g, unknown or other
  modified_base (221)..(221): a, c, t, g, unknown or other
  modified_base (261)..(261): a, c, t, g, unknown or other
  modified_base (267)..(267): a, c, t, g, unknown or other
  modified_base (286)..(286): a, c, t, g, unknown or other
  modified_base (293)..(293): a, c, t, g, unknown or other
  modified_base (303)..(303): a, c, t, g, unknown or other
  modified_base (314)..(314): a, c, t, g, unknown or other
cttctgtccttntttatggtaaaagtagggaactctgcttatgcacatcaacggaatcattattayancaganccttggactggggyattttgtaccccattggctcacctttcrtnttacnanagaaggctttctnacngagttttygtcacactccttccccgccngttgcccctcgttgtgcctgaagattmgctcwtgncgcctgangaagaaagtngtctgccttacgaccaaaagcctgtggcaaattttgagtnctttcnatcagggccgttgcctggntgcatgnactcaccccnaaagtccctcntttatc

SEQ ID NO: 4032 - DNA, 151 bp, Artificial Sequence
  Description of Artificial Sequence: Synthetic polynucleotide
  misc_feature (62)..(62): May or may not be present
  modified_base (70)..(70): a, c, t, g, unknown or other
  modified_base (91)..(91): a, c, t, g, unknown or other
tacttcttcctatactggtttattattccaataaaattcctatattcctgaattttttttttctttctanttctcwggtattcattactcngtaacctcttccaaatgacatacawacttgaaaaatagtgagaaaaaacttcttctagtt

SEQ ID NO: 4033 - DNA, 181 bp, Artificial Sequence
  Description of Artificial Sequence: Synthetic polynucleotide
  modified_base (69)..(69): a, c, t, g, unknown or other
  modified_base (102)..(102): a, c, t, g, unknown or other
  modified_base (154)..(154): a, c, t, g, unknown or other
  modified_base (176)..(176): a, c, t, g, unknown or other
ttcttgtttttcctgtctttgtaactagactttaaagctcctcaaaagagctggagtataaaygaaaanacaaagagctttgagtytcagatctggaaaaantctagctttatcatatacatacataaatttaaatgctggattcctcaccagnaaaagggtcttggattaagtgntataa

SEQ ID NO: 4034 - DNA, 324 bp, Artificial Sequence
  Description of Artificial Sequence: Synthetic polynucleotide
  modified_base (97)..(97): a, c, t, g, unknown or other
  modified_base (174)..(174): a, c, t, g, unknown or other
  modified_base (204)..(204): a, c, t, g, unknown or other
  modified_base (227)..(227): a, c, t, g, unknown or other
  modified_base (268)..(268): a, c, t, g, unknown or other
  modified_base (270)..(270): a, c, t, g, unknown or other
aattatttctttttgttgataagaatatgatattttgttggtaagaataggacatatggccttgcttagaagaaaggtgactaagaattgtagttcngaaggggagctattttccagtaacagctctacactctagaagaagatataagaaaattgatgaatacttagttcccngtaatttactctgtctcctataatctgagnttttaatttctccagtgcagtgnttatctgattatcctttgtagataatttcctttgtaagtananttctgtactagggagarcttcacttttcttctttgtctactaacatacttcagg

SEQ ID NO: 4035 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaaraaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4036 - DNA, 218 bp, Artificial Sequence
  Description of Artificial Sequence: Synthetic polynucleotide
  modified_base (50)..(50): a, c, t, g, unknown or other
  modified_base (59)..(59): a, c, t, g, unknown or other
  modified_base (82)..(82): a, c, t, g, unknown or other
  modified_base (84)..(84): a, c, t, g, unknown or other
  modified_base (92)..(92): a, c, t, g, unknown or other
  modified_base (201)..(201): a, c, t, g, unknown or other
  modified_base (216)..(216): a, c, t, g, unknown or other
taacaatatgtttattataacatccagccaagaatacaaacacaaaatanctcttaatntaaggagaataagaaaacatcangngattcttngartactactacaaatacagccttcacctacagtaaaaattaagccaatttcaatcattttggtcatcatcccagtctttcttcccacttggaggcttgggcccaccanctggttttgccatgnat

SEQ ID NO: 4037 - DNA, 308 bp, Artificial Sequence
  Description of Artificial Sequence: Synthetic polynucleotide
  modified_base (35)..(35): a, c, t, g, unknown or other
  modified_base (63)..(63): a, c, t, g, unknown or other
  modified_base (73)..(73): a, c, t, g, unknown or other
  modified_base (81)..(81): a, c, t, g, unknown or other
  modified_base (173)..(173): a, c, t, g, unknown or other
  modified_base (220)..(220): a, c, t, g, unknown or other
  modified_base (261)..(261): a, c, t, g, unknown or other
  modified_base (304)..(304): a, c, t, g, unknown or other
tatatcaactggtaaaactttattttacaagcaanaggaattggatcaaatgattattataanccagaggaantattttgnaaccacagcaaatgccattatacatactgccaatacasatttaatagacaatactgaactgtacaagagttatttatttttccttaatctcnaagcyatttttagtaatacaaaaaagccatattaacatttttttccngttagaaaacatgatgtacaaaactttggatgaraagatangtcaaatttcrtttaatcacttggaggaaaatccaccaactcntcaa

SEQ ID NO: 4038 - DNA, 150 bp, Artificial Sequence
  Description of Artificial Sequence: Synthetic polynucleotide
  modified_base (6)..(6): a, c, t, g, unknown or other
  modified_base (25)..(25): a, c, t, g, unknown or other
  modified_base (29)..(29): a, c, t, g, unknown or other
  modified_base (32)..(32): a, c, t, g, unknown or other
  modified_base (37)..(37): a, c, t, g, unknown or other
  modified_base (41)..(41): a, c, t, g, unknown or other
  modified_base (83)..(83): a, c, t, g, unknown or other
  modified_base (97)..(97): a, c, t, g, unknown or other
  modified_base (99)..(99): a, c, t, g, unknown or other
  modified_base (128)..(128): a, c, t, g, unknown or other
  modified_base (131)..(131): a, c, t, g, unknown or other
  modified_base (137)..(137): a, c, t, g, unknown or other
agaggncacagaggagagagaatcntganaanatttntaanatctgaaagttcttgtattaaaagaagtggraagtttcttgntatgtgtatgaagncnaagattgagatagtggtactgagggtggnatnataccncattgaggctggg

SEQ ID NO: 4039 - DNA, 346 bp, Artificial Sequence
  Description of Artificial Sequence: Synthetic polynucleotide
  modified_base (12)..(12): a, c, t, g, unknown or other
  modified_base (29)..(29): a, c, t, g, unknown or other
  modified_base (46)..(46): a, c, t, g, unknown or other
  modified_base (87)..(87): a, c, t, g, unknown or other
  modified_base (89)..(89): a, c, t, g, unknown or other
  modified_base (119)..(119): a, c, t, g, unknown or other
  modified_base (140)..(140): a, c, t, g, unknown or other
  modified_base (177)..(177): a, c, t, g, unknown or other
  modified_base (218)..(218): a, c, t, g, unknown or other
  modified_base (222)..(222): a, c, t, g, unknown or other
  modified_base (237)..(237): a, c, t, g, unknown or other
  modified_base (255)..(255): a, c, t, g, unknown or other
  modified_base (258)..(258): a, c, t, g, unknown or other
  modified_base (281)..(281): a, c, t, g, unknown or other
  modified_base (303)..(303): a, c, t, g, unknown or other
  modified_base (309)..(309): a, c, t, g, unknown or other
  modified_base (311)..(311): a, c, t, g, unknown or other
cataaagcagtntatttttcttaaaaagnaaggtacatggtcacantccaaaatgttttatacagctctcagcytggaaaatgcaantnatgaaaaaggcactgtttctagaacaratngaaaaagaataaatatgtcancatttaccctgcacagctttgagtaacaccataggancctgtcacaygttcagggtcaattttaaaagcttgagaagnacanagcaaggtgatgtcntagactagccaggctccnaanggaagagctgtctgtccctcctnmactgtcctctctctgtcacangtgtcntntcactgttcctctagcagatgtggaaagtggctgc

SEQ ID NO: 4040 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttygtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4041 - DNA, 99 bp, Artificial Sequence
  Description of Artificial Sequence: Synthetic oligonucleotide
  modified_base (9)..(9): a, c, t, g, unknown or other
  modified_base (11)..(11): a, c, t, g, unknown or other
  modified_base (17)..(17): a, c, t, g, unknown or other
  modified_base (38)..(38): a, c, t, g, unknown or other
  modified_base (51)..(51): a, c, t, g, unknown or other
  modified_base (62)..(62): a, c, t, g, unknown or other
  modified_base (67)..(67): a, c, t, g, unknown or other
aacgttttncnccttcnagactcaggaggatgaaagtnatcacttgtgaantagcctggcanacaangagccygtgtacagcctggacttccagcatgg

SEQ ID NO: 4042 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacargcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4043 - DNA, 134 bp, Artificial Sequence
  Description of Artificial Sequence: Synthetic polynucleotide
  modified_base (8)..(8): a, c, t, g, unknown or other
  modified_base (92)..(92): a, c, t, g, unknown or other
gtcacctnacttttgaatgccgcaattttctcygagtagaccctaaaagggacatagttttggatgtcagcagtacaagtagtgaagatagngatgaagagaatgaagaactgaataaadtgcaggcattacag

SEQ ID NO: 4044 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcycctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4045 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgscacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4046 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttccncttatttaatttatgccacaataacagtagcttcagtgcagagctgcagcttcaagctttacrtttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 4047 - DNA, 110 bp, Artificial Sequence
  Description of Artificial Sequence: Synthetic polynucleotide
  modified_base (5)..(5): a, c, t, g, unknown or other
  misc_feature (37)..(44): This region may encompass 'ggaagtcc' or is absent in its entirety
  modified_base (47)..(47): a, c, t, g, unknown or other
  modified_base (52)..(52): a, c, t, g, unknown or other
  modified_base (59)..(59): a, c, t, g, unknown or other
  modified_base (93)..(93): a, c, t, g, unknown or other
  modified_base (102)..(102): a, c, t, g, unknown or other
tcgcntgtgatccttcaggtcctgccagctgcctgaggaagtcctgngaagnaagtccnatttcttccataaatagcatcctctgcatctcgngggtcctcnaagcgcac

SEQ ID NO: 4048 - DNA, 127 bp, Artificial Sequence
  Description of Artificial Sequence: Synthetic polynucleotide
  modified_base (21)..(21): a, c, t, g, unknown or other
  modified_base (38)..(38): a, c, t, g, unknown or other
  modified_base (58)..(58): a, c, t, g, unknown or other
  modified_base (91)..(91): a, c, t, g, unknown or other
  modified_base (118)..(118): a, c, t, g, unknown or other
ggattgaagatttcctccacnaccagctgaaaawattntttggaaacacctccctcanccttgttctccttcaaattccacatasaactgncttcaagtctgcaggattttccatagngatcatctc

SEQ ID NO: 4049 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccyattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4050 - DNA, 423 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (38)..(38): a, c, t, g, unknown or other
  modified_base (42)..(42): a, c, t, g, unknown or other
  modified_base (53)..(53): a, c, t, g, unknown or other
  modified_base (72)..(72): a, c, t, g, unknown or other
  modified_base (87)..(87): a, c, t, g, unknown or other
  modified_base (91)..(91): a, c, t, g, unknown or other
  modified_base (101)..(101): a, c, t, g, unknown or other
  modified_base (111)..(111): a, c, t, g, unknown or other
  modified_base (157)..(157): a, c, t, g, unknown or other
  modified_base (159)..(159): a, c, t, g, unknown or other
  modified_base (168)..(168): a, c, t, g, unknown or other
  modified_base (184)..(184): a, c, t, g, unknown or other
  modified_base (196)..(196): a, c, t, g, unknown or other
  modified_base (224)..(224): a, c, t, g, unknown or other
  modified_base (229)..(229): a, c, t, g, unknown or other
  modified_base (232)..(232): a, c, t, g, unknown or other
  modified_base (234)..(234): a, c, t, g, unknown or other
  modified_base (237)..(237): a, c, t, g, unknown or other
  modified_base (272)..(272): a, c, t, g, unknown or other
  modified_base (275)..(275): a, c, t, g, unknown or other
  modified_base (291)..(291): a, c, t, g, unknown or other
  modified_base (296)..(296): a, c, t, g, unknown or other
  modified_base (299)..(299): a, c, t, g, unknown or other
  modified_base (313)..(313): a, c, t, g, unknown or other
  modified_base (322)..(322): a, c, t, g, unknown or other
  modified_base (347)..(347): a, c, t, g, unknown or other
  modified_base (358)..(358): a, c, t, g, unknown or other
  modified_base (409)..(409): a, c, t, g, unknown or other
ggtcnagcgatggngccttcctggccatttcttccacngacngttactgctcntttgtgacatttgagaaantgaacttggaattcntttnaaagagaagncagttttgancatgagaactcctgatacagcaaagaaaaccaagagtcagacacancnagggtcttngccaggacccagaccngtagagggaacnctgccagcagaacccaagaccccagcanccccngcncnacnccymctcaggccagacaggccccagccccaacagncancagggaccctccctcnatcantcntgctgtcaaaagcnccttgccgnggccttcggaggagaagaccctgcngcccagtagtnaaaacacaaaagcccayccatcccggagggtcactctgaacacactgcaancctggagcaagaca

SEQ ID NO: 4051 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacytgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4052 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  misc_feature (457)..(457): May or may not be present
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaaagcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4053 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccrtctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4054 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagygccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4055 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (164)..(164): a, c, t, g, unknown or other
  modified_base (176)..(176): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgytaacttttgaaaatgaaagccntggacattctgngtaggtgtttggcacccaaaatttcactgaagaagaatgctgtttcttantatcaaaccaaagtgcaaagcaatataaattagaggccaagncttctcttgncgntcnatttacttctgtaaaacagattctatgttccttttctatgancantttacatttgaaacattagattttttcactnatgagggaaggaaangggcttctgtnctacttnaagncngngaagctaaggtctccttctcaaagnagagcnggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 4056 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttrctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4057 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1028)..(1028): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1729)..(1729): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaamataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4058 - DNA, 2427 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  misc_feature (2058)..(2065): This region may encompass 'taaaaaaa' or is absent in its entirety
  modified_base (2105)..(2105): a, c, t, g, unknown or other
  modified_base (2124)..(2124): a, c, t, g, unknown or other
  modified_base (2133)..(2133): a, c, t, g, unknown or other
  modified_base (2193)..(2193): a, c, t, g, unknown or other
  modified_base (2209)..(2209): a, c, t, g, unknown or other
  modified_base (2227)..(2227): a, c, t, g, unknown or other
  modified_base (2237)..(2237): a, c, t, g, unknown or other
  modified_base (2253)..(2253): a, c, t, g, unknown or other
  modified_base (2255)..(2255): a, c, t, g, unknown or other
  modified_base (2283)..(2283): a, c, t, g, unknown or other
  modified_base (2297)..(2297): a, c, t, g, unknown or other
  modified_base (2299)..(2299): a, c, t, g, unknown or other
  modified_base (2405)..(2405): a, c, t, g, unknown or other
  modified_base (2414)..(2414): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttctttaaaaaaaaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4059 - DNA, 100 bp, Artificial Sequence
  Description of Artificial Sequence: Synthetic polynucleotide
  modified_base (74)..(74): a, c, t, g, unknown or other
gaatgataacataagattaggaacaagaataygtgtgtatagattttaacatttatatctgtgaatattaatcnatatatacagatcttgaaggcaagtt

SEQ ID NO: 4060 - DNA, 516 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  modified_base (184)..(184): a, c, t, g, unknown or other
  modified_base (215)..(215): a, c, t, g, unknown or other
  modified_base (218)..(218): a, c, t, g, unknown or other
  modified_base (243)..(243): a, c, t, g, unknown or other
  modified_base (250)..(250): a, c, t, g, unknown or other
  modified_base (258)..(258): a, c, t, g, unknown or other
  modified_base (272)..(272): a, c, t, g, unknown or other
  modified_base (274)..(274): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (335)..(335): a, c, t, g, unknown or other
  modified_base (381)..(381): a, c, t, g, unknown or other
  modified_base (403)..(403): a, c, t, g, unknown or other
  modified_base (413)..(413): a, c, t, g, unknown or other
  modified_base (441)..(441): a, c, t, g, unknown or other
  modified_base (456)..(456): a, c, t, g, unknown or other
  modified_base (458)..(458): a, c, t, g, unknown or other
  modified_base (477)..(477): a, c, t, g, unknown or other
  modified_base (480)..(480): a, c, t, g, unknown or other
  modified_base (495)..(495): a, c, t, g, unknown or other
  modified_base (500)..(500): a, c, t, g, unknown or other
  modified_base (513)..(513): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagnaagtaaaaggcatcccattagtcttttcagntcntagtcaaggacaatkatcatgaatnaatctgnttactatntacttaacacaagntntgagaagaaaagcatcatagttctgaaatgrtgatngntcnctaagccacaaatgagaggnaggtttcccacctatctcagttgataatgtccaaaaacatccttcnccatgcatcagagtagaaaganaatgtacctnctactatgtcaaatggaatagataactncaaartaggaacacntnagaacattctctaacattntancagtctgatgcttcnccttntctgccacttcanara

SEQ ID NO: 4061 - DNA, 442 bp, Artificial Sequence
  Description of Artificial Sequence: Synthetic polynucleotide
  modified_base (10)..(10): a, c, t, g, unknown or other
  modified_base (52)..(52): a, c, t, g, unknown or other
  modified_base (75)..(75): a, c, t, g, unknown or other
  modified_base (79)..(79): a, c, t, g, unknown or other
  modified_base (102)..(102): a, c, t, g, unknown or other
  modified_base (134)..(134): a, c, t, g, unknown or other
  modified_base (152)..(152): a, c, t, g, unknown or other
  modified_base (167)..(167): a, c, t, g, unknown or other
  modified_base (182)..(182): a, c, t, g, unknown or other
  modified_base (189)..(189): a, c, t, g, unknown or other
  modified_base (199)..(199): a, c, t, g, unknown or other
  modified_base (225)..(225): a, c, t, g, unknown or other
  modified_base (237)..(237): a, c, t, g, unknown or other
  modified_base (262)..(262): a, c, t, g, unknown or other
  modified_base (270)..(270): a, c, t, g, unknown or other
  modified_base (279)..(279): a, c, t, g, unknown or other
  modified_base (298)..(298): a, c, t, g, unknown or other
  modified_base (306)..(306): a, c, t, g, unknown or other
  modified_base (348)..(348): a, c, t, g, unknown or other
  modified_base (392)..(392): a, c, t, g, unknown or other
  modified_base (405)..(405): a, c, t, g, unknown or other
  modified_base (419)..(419): a, c, t, g, unknown or other
  modified_base (426)..(426): a, c, t, g, unknown or other
ttgtcagagntcagggtacaagcagctgtctgactccaaaccctttatrgangctgcctggctttttctctagcncttnacttcttaattagtgcagagaancaagtcttgcctttcatttcttcccctgcacngaagaaaaatctaaaagncatccttttgtaacntgaaaacttggaatnaaaaatncattaaaatnttatctatagaaacactcccaaagcntcatagcaaganattcagataaaagcacatattttcnctactttnatgtgcatnagtttaaastccatgactnttattttnatcttcatcattccctatttgactgatttttaacctatcatnttacaccatggagtggcaaatactatcaaggaatcaaaaaaagncaactccttcaanaatctaatttatangaaatanagtaaattacaatgat

SEQ ID NO: 4062 - DNA, 218 bp, Artificial Sequence
  Description of Artificial Sequence: Synthetic polynucleotide
  modified_base (59)..(59): a, c, t, g, unknown or other
  modified_base (82)..(82): a, c, t, g, unknown or other
  modified_base (84)..(84): a, c, t, g, unknown or other
  modified_base (92)..(92): a, c, t, g, unknown or other
  modified_base (95)..(95): a, c, t, g, unknown or other
  modified_base (201)..(201): a, c, t, g, unknown or other
  modified_base (216)..(216): a, c, t, g, unknown or other
taacaatatgtttattataacatccagccaagaatacaaacacaaaatamctcttaatntaaggagaataagaaaacatcangngattcttngantactactacaaatacagccttcacctacagtaaaaattaagccaatttcaatcattttggtcatcatcccagtctttcttcccacttggaggcttgggcccaccanctggttttgccatgnat

SEQ ID NO: 4063 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (241)..(241): a, c, t, g, unknown or other
  modified_base (279)..(279): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (359)..(359): a, c, t, g, unknown or other
  modified_base (389)..(389): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccanccccttcngttctgtggcattgncacaatnaggaatctacttttgtgcttttacacattgaactgacaggtranrtcaggcatcgactgtcacaggggccagtggagaggtngnagggacgcccacattcgatgaatcctgcatcayggtgttggacttcttgttnttngacactaaacttgttcacattynataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4064 - DNA, 522 bp, Artificial Sequence
  Description of Artificial Sequence: Synthetic polynucleotide
  modified_base (26)..(26): a, c, t, g, unknown or other
  modified_base (63)..(63): a, c, t, g, unknown or other
  modified_base (174)..(174): a, c, t, g, unknown or other
  modified_base (245)..(285): a, c, t, g, unknown or other
  modified_base (337)..(337): a, c, t, g, unknown or other
  modified_base (399)..(399): a, c, t, g, unknown or other
  modified_base (440)..(440): a, c, t, g, unknown or other
  modified_base (489)..(489): a, c, t, g, unknown or other
  modified_base (493)..(493): a, c, t, g, unknown or other
agtagatacattttayatagaatttngttaagtattccttaaaatatcactttaatatgccanaagaataaccacagaatagtgttactttaaagtaaaaagatayaaatagragcccaaaatgttaagtggggttttacaatcaagaagacacaccagaataagatatttttnaaataccatgtacrttaaagagatcatacttccttaccctaataaayagccatgtagtacaagttttaacnnnnnnnnnnnnnnnnnnnnnnnnnnnnnnnnnnnnnnnnncaacttctatttggttttayctgagccattcctttatactgacagttacatnatgtgatttcagttatatatgtagttwttggtaatttttcaaaaatagaatataatgaaaancttcatttsaatcattactgaactgcacctacattaatcanatatacctatgaaaagatgtataacatatactagtatgccaaaaaaaanaagnkacaaaacagtatttatagtataattcca

SEQ ID NO: 4065 - DNA, 162 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (27)..(27): a, c, t, g, unknown or other
  modified_base (67)..(67): a, c, t, g, unknown or other
  modified_base (96)..(96): a, c, t, g, unknown or other
  modified_base (99)..(99): a, c, t, g, unknown or other
  modified_base (101)..(101): a, c, t, g, unknown or other
  modified_base (125)..(125): a, c, t, g, unknown or other
anctacatcgtyatcntggcctgggcnacakactacctgttccagtccttccagaaggagctgcccngggcacactgcaaccacagctggaacacnccncnctgcatggaggacaccatgcgcangaacragagtgtctggatcaccatcagctccaccaac

SEQ ID NO: 4066 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  misc_feature (89)..(89): May or may not be present
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (226)..(226): a, c, t, g, unknown or other
  modified_base (243)..(243): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctactttcaagttctttccccaaacttttctcacctatgtttncctatggggctntngaytcagnttcatgngcaatgtgttcctataaagaagaaggagtgtagggycaccttcngcttatgttttagctctagaggatgagngaagagccaacgtgtgncagtttgaggatggatgtacagtgagtagtgaggggctttttccaccttgaanrcatgagngctcttgagnccctcccactgnanttcagagtcaccagatntgtgcatgatatctctgc

SEQ ID NO: 4067 - DNA, 151 bp, Artificial Sequence
  Description of Artificial Sequence: Synthetic polynucleotide
  modified_base (8)..(8): a, c, t, g, unknown or other
  modified_base (34)..(34): a, c, t, g, unknown or other
  modified_base (64)..(64): a, c, t, g, unknown or other
  modified_base (68)..(68): a, c, t, g, unknown or other
  modified_base (70)..(70): a, c, t, g, unknown or other
  modified_base (85)..(85): a, c, t, g, unknown or other
  modified_base (89)..(89): a, c, t, g, unknown or other
  modified_base (91)..(91): a, c, t, g, unknown or other
  modified_base (115)..(115): a, c, t, g, unknown or other
  modified_base (119)..(119): a, c, t, g, unknown or other
  modified_base (137)..(137): a, c, t, g, unknown or other
  modified_base (143)..(143): a, c, t, g, unknown or other
gtacaagngaaacattcatcagaatgtgacccancctgaaayaggagggaggaaaatctttaanagtntnacaggtaaggtcccnaaancncaaaataataagggggtaatgtanattnctcacccagtcttggcancaattntgtrcttt

SEQ ID NO: 4068 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatartctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4069 - DNA, 785 bp, Artificial Sequence
  Description of Artificial Sequence: Synthetic polynucleotide
  modified_base (17)..(17): a, c, t, g, unknown or other
  modified_base (20)..(20): a, c, t, g, unknown or other
  modified_base (112)..(112): a, c, t, g, unknown or other
  modified_base (116)..(116): a, c, t, g, unknown or other
  modified_base (133)..(133): a, c, t, g, unknown or other
  modified_base (137)..(137): a, c, t, g, unknown or other
  modified_base (156)..(156): a, c, t, g, unknown or other
  modified_base (173)..(173): a, c, t, g, unknown or other
  modified_base (212)..(212): a, c, t, g, unknown or other
  modified_base (247)..(247): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (319)..(319): a, c, t, g, unknown or other
  modified_base (332)..(332): a, c, t, g, unknown or other
  modified_base (349)..(349): a, c, t, g, unknown or other
  modified_base (420)..(420): a, c, t, g, unknown or other
  modified_base (423)..(423): a, c, t, g, unknown or other
  modified_base (434)..(474): a, c, t, g, unknown or other
  modified_base (522)..(522): a, c, t, g, unknown or other
  modified_base (569)..(569): a, c, t, g, unknown or other
  modified_base (586)..(648): a, c, t, g, unknown or other
  modified_base (650)..(658): a, c, t, g, unknown or other
  modified_base (682)..(682): a, c, t, g, unknown or other
  modified_base (702)..(702): a, c, t, g, unknown or other
  modified_base (705)..(705): a, c, t, g, unknown or other
  modified_base (718)..(718): a, c, t, g, unknown or other
  modified_base (721)..(721): a, c, t, g, unknown or other
  modified_base (770)..(770): a, c, t, g, unknown or other
  modified_base (775)..(775): a, c, t, g, unknown or other
atatttttctttgcctncantgaattccctctcttggcaatgccttataagttaccatgcaaaaaaatataaatgtatctcatttatctgttctcccctaccccccacaacnctanctacctctcacaggacnaagnattggaaaggccttagtgnagccaccacctaaccanagaaatgatccaaactcacatactactacttctttattnttcagtaaagttctccaaactaaaatgaaatatgnagtttgaaaatangtagtaaaaatacagcttttnaaatatatcctctrtgctntttcatagccacttcacantgaccctacttcnccatttataactcaccnagttagttattagtaaacaactcttaatcaaaaktaaaaatgaagggctatggaactgttctcatatcccnttnagtgtcttaannnnnnnnnnnnnnnnnnnnnnnnnnnnnnnnnnnnnnnnnagcgcagtgtttaatgaacttgcctaaagycacatcagaaccaccagnaagcacaatttcattgtattttgtgtgaatgccctccccagcacaangaacggagctgtacaannnnnnnnnnnnnnnnnnnnnnnnnnnnnnnnnnnnnnnnnnnnnnnnnnnnnnnnnnnnnnnrnnnnnnnnnaaaacctccaaaaaacactgcttncatcactgaaattaaagamnaanaatacaatataantanaataaaatgagaattccttgttatataataagccagtttatcagctttntttgnaaggaagaaa

SEQ ID NO: 4070 - DNA, 693 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  misc_feature (404)..(405): This region may encompass 'tg' or 'ca'
  modified_base (435)..(435): a, c, t, g, unknown or other
  modified_base (447)..(447): a, c, t, g, unknown or other
  modified_base (454)..(454): a, c, t, g, unknown or other
  modified_base (473)..(473): a, c, t, g, unknown or other
  modified_base (483)..(483): a, c, t, g, unknown or other
  modified_base (492)..(492): a, c, t, g, unknown or other
  modified_base (515)..(515): a, c, t, g, unknown or other
  modified_base (523)..(523): a, c, t, g, unknown or other
  modified_base (530)..(530): a, c, t, g, unknown or other
  modified_base (540)..(540): a, c, t, g, unknown or other
  modified_base (569)..(569): a, c, t, g, unknown or other
  modified_base (585)..(585): a, c, t, g, unknown or other
  modified_base (622)..(622): a, c, t, g, unknown or other
  modified_base (627)..(627): a, c, t, g, unknown or other
  modified_base (633)..(633): a, c, t, g, unknown or other
  modified_base (654)..(654): a, c, t, g, unknown or other
  modified_base (662)..(662): a, c, t, g, unknown or other
  modified_base (665)..(665): a, c, t, g, unknown or other
  modified_base (667)..(667): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcyrggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 4071 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (83)..(83): a, c, t, g, unknown or other
  modified_base (119)..(119): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (328)..(328): a, c, t, g, unknown or other
  modified_base (344)..(344): a, c, t, g, unknown or other
  modified_base (383)..(383): a, c, t, g, unknown or other
  modified_base (390)..(390): a, c, t, g, unknown or other
  modified_base (405)..(405): a, c, t, g, unknown or other
  modified_base (412)..(412): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
  modified_base (489)..(489): a, c, t, g, unknown or other
ctccactgtgtgcagtggaatcctgggaaatttaagagctactctctntangcngagactttgnaggcccattcagaganctnaataaaacaacatggttgcaggtaatggcaacaagntntagctnaaatcacccangacatttagatrtgtattccaggctgttagtttaatgtttgctgtatgtacnatgtagtcntttctgttaattatntttcttaactaatttttagaaagagtactctanttgangttcanaactgatagggaraaaggtgggaatgggaatgggaaactgtacaaatatttaatgactctaaatatttgngagaactgaggaaatnwcacatggattatggtgctaaaaaggactgttatctaantgagttntttgtcctgatccanttcctgntccttatcttattgtactattccatcttctgccacttaaattcacagaaacaaaatgcaagnaaangntntcttncntgccttcccagactgatttaataaaaatggc

SEQ ID NO: 4072 - DNA, 271 bp, Artificial Sequence
  Description of Artificial Sequence: Synthetic polynucleotide
  modified_base (4)..(4): a, c, t, g, unknown or other
  modified_base (21)..(21): a, c, t, g, unknown or other
  modified_base (25)..(25): a, c, t, g, unknown or other
  modified_base (30)..(30): a, c, t, g, unknown or other
  modified_base (34)..(34): a, c, t, g, unknown or other
  modified_base (42)..(42): a, c, t, g, unknown or other
  modified_base (47)..(47): a, c, t, g, unknown or other
  modified_base (74)..(74): a, c, t, g, unknown or other
  modified_base (76)..(76): a, c, t, g, unknown or other
  modified_base (91)..(91): a, c, t, g, unknown or other
  modified_base (100)..(100): a, c, t, g, unknown or other
  modified_base (110)..(110): a, c, t, g, unknown or other
  modified_base (150)..(150): a, c, t, g, unknown or other
  modified_base (152)..(152): a, c, t, g, unknown or other
  modified_base (187)..(187): a, c, t, g, unknown or other
  modified_base (201)..(201): a, c, t, g, unknown or other
  modified_base (214)..(214): a, c, t, g, unknown or other
  modified_base (218)..(218): a, c, t, g, unknown or other
  modified_base (266)..(266): a, c, t, g, unknown or other
aaanaggtatataccagcctnctcnggaanctgntggtggancttangactggaaactgttgaaagttaaaaananttcccaaaccttgancatctactngacaaatttnatgtgtaccagggacaaatgaaagtatccttccaaaatangncccaaattattgtcaagcctttctrtaataaaggnccattcctcaagcngctgtcacataangtgnaggtgatcaacagcaaatccattagcaacacaggataaagaaatttgnrtagc

SEQ ID NO: 4073 - DNA, 124 bp, Artificial Sequence
  Description of Artificial Sequence: Synthetic polynucleotide
  modified_base (2)..(2): a, c, t, g, unknown or other
  modified_base (100)..(100): a, c, t, g, unknown or other
  modified_base (107)..(107): a, c, t, g, unknown or other
  modified_base (112)..(112): a, c, t, g, unknown or other
ancgcamcccaggrcctcctcgtgggggtccaccgctgcagyaccgccaggcagcagcatcccacctcttccgccttgctgcagctccaccaggtccccnctctagncaggncggggcaggcca

SEQ ID NO: 4074 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (444)..(444): a, c, t, g, unknown or other
  modified_base (478)..(478): a, c, t, g, unknown or other
  modified_base (483)..(483): a, c, t, g, unknown or other
  modified_base (656)..(656): a, c, t, g, unknown or other
  modified_base (696)..(696): a, c, t, g, unknown or other
  modified_base (698)..(698): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggnctagccattaaagctgatgtctcttagttgcaancccancctctgggtttctggtgaagcttgagctctgcacagcaactggctttgcgtgagtctctaccacaagaacacactatgyggagacaataggctagagaaggggaagggatctgtgccttctttttgtctccttgtctgcaccctaatcccatcaaggtcactccttggtaccntcattcagcctggtgaatgaaggccctccaataacaaganangtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4075 - DNA, 524 bp, Artificial Sequence
  Description of Artificial Sequence: Synthetic polynucleotide
  modified_base (216)..(216): a, c, t, g, unknown or other
ttccttatttgaaccagatttatttaataatcacaatctaattttagatagtttctgttttccagaaaatgcaagctagagatcattagagcaattagtacaarataaactttagaatattgcatttggccagaccagatgtaaaatcattagggaataaacataaccatgcttcatagaascccactattcagacattagatgagttttagatcngatgacataatgacaggcctcatttaaaaagactaataacttagtgaaaaccatgtgtatttctacaayactatttgcattttactaatttaatctcacgcattcactgagggtactgacattttagccagtgtgagcatgagaagcaggtgactcatgtatgatctaaatgcaccacatcaagatgactagttgagttgtattcagaagggctgaaataatgtgttattatccaaaacaccatagttatataaaaacaggcagcatagcagatacctgaaaaaatgttttttttggatgaataaggg

SEQ ID NO: 4076 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcartatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4077 - DNA, 150 bp, Artificial Sequence
  Description of Artificial Sequence: Synthetic polynucleotide
  modified_base (6)..(6): a, c, t, g, unknown or other
  modified_base (25)..(25): a, c, t, g, unknown or other
  modified_base (29)..(29): a, c, t, g, unknown or other
  modified_base (32)..(32): a, c, t, g, unknown or other
  modified_base (37)..(37): a, c, t, g, unknown or other
  modified_base (41)..(41): a, c, t, g, unknown or other
  modified_base (72)..(72): a, c, t, g, unknown or other
  modified_base (83)..(83): a, c, t, g, unknown or other
  modified_base (97)..(97): a, c, t, g, unknown or other
  modified_base (128)..(128): a, c, t, g, unknown or other
  modified_base (131)..(131): a, c, t, g, unknown or other
  modified_base (137)..(137): a, c, t, g, unknown or other
agaggncacagaggagagagaatcntganaanatttntaanatctgaaagttcttgtattaaaagaagtggnaagtttcttgntatgtgtatgaagncyaagattgagatagtggtactgagggtggnatnataccncattgaggctggg

SEQ ID NO: 4078 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttsataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4079 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  modified_base (369)..(369): a, c, t, g, unknown or other
  modified_base (406)..(406): a, c, t, g, unknown or other
  modified_base (510)..(510): a, c, t, g, unknown or other
  modified_base (530)..(530): a, c, t, g, unknown or other
  modified_base (579)..(579): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacntatctgtgggaaaagcatttttagtagaatgcttgcncatcttcctacattcctgtaatcaaacagtatttatcatcamctatgttggtgactctcactttgacataggctgaaccagaaatcctaggaaaaactgatganagaaagctaaggggaagganaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4080 - DNA, 285 bp, Artificial Sequence
  Description of Artificial Sequence: Synthetic polynucleotide
  modified_base (16)..(16): a, c, t, g, unknown or other
  modified_base (20)..(20): a, c, t, g, unknown or other
  modified_base (25)..(25): a, c, t, g, unknown or other
  modified_base (29)..(29): a, c, t, g, unknown or other
  modified_base (89)..(89): a, c, t, g, unknown or other
  modified_base (144)..(144): a, c, t, g, unknown or other
  modified_base (147)..(147): a, c, t, g, unknown or other
  modified_base (151)..(151): a, c, t, g, unknown or other
  modified_base (167)..(167): a, c, t, g, unknown or other
  modified_base (184)..(184): a, c, t, g, unknown or other
  modified_base (194)..(194): a, c, t, g, unknown or other
taatgacaataataanctgngcccngcanggtcagctaatgccacatggtaattgctgcrtgtgtgagtagcaaaatcacatggaagangagctggccttggggacaatgccacgttacagtgaggagctccagaaaaacccangtnaaanttctcaggttcacgcntgggtgcccatcctctncctgaycccncaaaaraataaagatcttayaaatatccaatgaataccaggatggaaataacttgtttccyggcatycaagacagaggaaatccttactat

SEQ ID NO: 4081 - DNA, 1290 bp, Artificial Sequence
  Description of Artificial Sequence: Synthetic polynucleotide
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  modified_base (623)..(623): a, c, t, g, unknown or other
  modified_base (833)..(833): a, c, t, g, unknown or other
  modified_base (862)..(862): a, c, t, g, unknown or other
  modified_base (1049)..(1049): a, c, t, g, unknown or other
  modified_base (1099)..(1099): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccytgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4082 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcrangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4083 - DNA, 100 bp, Artificial Sequence
  Description of Artificial Sequence: Synthetic polynucleotide
  modified_base (76)..(76): a, c, t, g, unknown or other
  modified_base (79)..(79): a, c, t, g, unknown or other
  modified_base (99)..(99): a, c, t, g, unknown or other
cgccgcacatcccctctcgcccctcygccccgggccaggaccttcctggccgcacagaacccaccttccttcccgntgnagagctgctccgcttccccna

SEQ ID NO: 4084 - DNA, 204 bp, Artificial Sequence
  Description of Artificial Sequence: Synthetic polynucleotide
  modified_base (22)..(22): a, c, t, g, unknown or other
  modified_base (89)..(89): a, c, t, g, unknown or other
  modified_base (92)..(92): a, c, t, g, unknown or other
  modified_base (100)..(100): a, c, t, g, unknown or other
  modified_base (102)..(102): a, c, t, g, unknown or other
  modified_base (131)..(131): a, c, t, g, unknown or other
  modified_base (140)..(140): a, c, t, g, unknown or other
  modified_base (172)..(172): a, c, t, g, unknown or other
aagtgaatatagttgatttgangctagtgtgaccaggaatatttgagtgtgtgtgtgctctttgyattacttggtgagtgtgtgccccntgngtgtgtgngngggtcattacctgtgactctacatatganggtgttganagtgtgtgtgagtctgtgagcatgtttatatncatgtggattgttagtatgcatgcttttagag

SEQ ID NO: 4085 - DNA, 146 bp, Artificial Sequence
  Description of Artificial Sequence: Synthetic polynucleotide
  modified_base (8)..(8): a, c, t, g, unknown or other
  modified_base (66)..(66): a, c, t, g, unknown or other
  modified_base (75)..(75): a, c, t, g, unknown or other
  modified_base (78)..(78): a, c, t, g, unknown or other
  modified_base (96)..(96): a, c, t, g, unknown or other
  modified_base (105)..(105): a, c, t, g, unknown or other
caygtgcncctgctgctgtatatcttggcagcaaaaacattaattctctgcctgrcatttgctggngtgaaaatntancaaagaaaaaggttggangcaaaacancaaaaactggaggctgaaaggaagargcaatcagagaaaar

SEQ ID NO: 4086 - DNA, 109 bp, Artificial Sequence
  Description of Artificial Sequence: Synthetic polynucleotide
  modified_base (14)..(14): a, c, t, g, unknown or other
  modified_base (47)..(47): a, c, t, g, unknown or other
  modified_base (52)..(52): a, c, t, g, unknown or other
  modified_base (62)..(62): a, c, t, g, unknown or other
  modified_base (71)..(71): a, c, t, g, unknown or other
gggctcccatctgnttttgyagaatcagagaatgtgatcactgmaanggttnaggggagggngcaggggangaaggggsagggccaaaggctggagggacaatagctca

SEQ ID NO: 4087 - DNA, 200 bp, Artificial Sequence
  Description of Artificial Sequence: Synthetic polynucleotide
  modified_base (129)..(129): a, c, t, g, unknown or other
taaagcattttattcagatcaaaagccctagagaaaaatggcactgaaaatataatataaaattttcatcccaaagcttttcaaacatattatttgaatactcttagccctttcacagcatttgatwcnttgacttgccaccttaccatttaagttaaaagtaatagtatttatgttgtagtccagtatagcacactgac

SEQ ID NO: 4088 - DNA, 398 bp, Artificial Sequence
  Description of Artificial Sequence: Synthetic polynucleotide
  modified_base (5)..(5): a, c, t, g, unknown or other
  modified_base (30)..(30): a, c, t, g, unknown or other
  modified_base (42)..(42): a, c, t, g, unknown or other
  modified_base (55)..(55): a, c, t, g, unknown or other
  modified_base (57)..(57): a, c, t, g, unknown or other
  modified_base (77)..(77): a, c, t, g, unknown or other
  modified_base (94)..(94): a, c, t, g, unknown or other
  modified_base (97)..(97): a, c, t, g, unknown or other
  modified_base (99)..(99): a, c, t, g, unknown or other
  modified_base (118)..(118): a, c, t, g, unknown or other
  modified_base (170)..(170): a, c, t, g, unknown or other
  modified_base (180)..(180): a, c, t, g, unknown or other
  modified_base (187)..(187): a, c, t, g, unknown or other
  modified_base (202)..(202): a, c, t, g, unknown or other
  modified_base (206)..(206): a, c, t, g, unknown or other
  modified_base (226)..(226): a, c, t, g, unknown or other
  modified_base (232)..(232): a, c, t, g, unknown or other
  modified_base (234)..(234): a, c, t, g, unknown or other
  modified_base (274)..(274): a, c, t, g, unknown or other
  modified_base (327)..(327): a, c, t, g, unknown or other
  modified_base (334)..(334): a, c, t, g, unknown or other
  modified_base (342)..(342): a, c, t, g, unknown or other
  modified_base (350)..(350): a, c, t, g, unknown or other
  modified_base (367)..(367): a, c, t, g, unknown or other
  modified_base (374)..(374): a, c, t, g, unknown or other
  modified_base (391)..(391): a, c, t, g, unknown or other
tcccncaaatccatctacatcaaatttgtngaagtagagagngattttctttccncnggctctttagttgagtgccngaaaaagccaytggatnccncntaaaatttaacaactgaangtcatccttcataaggatttgggctcttagctccttcttctctactcacttnccattacccngaccacncctcatccagatgcngccntcagactcttcatggaaacnctttcntnattgggccagtaygacttctaaggaatcatagtagacttnggccagaaaaaacagacctcacctgaaaatgctcattttgagcaagcaagatntatagcnaacttgcntggtgggncagctatttcttttttnaaaacanaaaaacaatttttaaanggatttt

SEQ ID NO: 4089 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagmtaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4090 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccaygggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4091 - DNA, 337 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (21)..(21): a, c, t, g, unknown or other
  modified_base (39)..(39): a, c, t, g, unknown or other
  modified_base (44)..(44): a, c, t, g, unknown or other
  modified_base (58)..(58): a, c, t, g, unknown or other
  modified_base (88)..(88): a, c, t, g, unknown or other
  modified_base (99)..(99): a, c, t, g, unknown or other
  modified_base (117)..(117): a, c, t, g, unknown or other
  modified_base (147)..(147): a, c, t, g, unknown or other
  misc_feature (191)..(191): May or may not be present
  modified_base (216)..(216): a, c, t, g, unknown or other
  modified_base (230)..(230): a, c, t, g, unknown or other
  modified_base (235)..(235): a, c, t, g, unknown or other
  modified_base (263)..(263): a, c, t, g, unknown or other
  modified_base (302)..(302): a, c, t, g, unknown or other
ttctntctcatgcctntctgnctrtgtccacagtgtctnaattnaaggtccttggtcntcaaggaaccaagactacactgagatccantcttgggaagngcctctccttcaacctcnggtaccactcatccataaacaccaacactntttgcctctttgtgtatcataaagtccctcattgaaacagccccttaaactccagtctggaaaacaaanccactgggctacantaagnaccaattttagacacagacatcctcccncttcctcttgaccccaggtattctctgccaaactacaantcctccaggaaatcagcatctagcagcacccccac

SEQ ID NO: 4092 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggrcaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4093 - DNA, 400 bp, Artificial Sequence
  Description of Artificial Sequence: Synthetic polynucleotide
  modified_base (182)..(182): a, c, t, g, unknown or other
  modified_base (358)..(358): a, c, t, g, unknown or other
acagtcaagaagcwgataggtgactgctattcccctctygctgaaaacgcagccacttggagtcagcttgatggcagtggtggctcaggccttgaacacgtgagaatagactatgttgtcaagatgctgatgaaccgcacttctgcctgacttgrtgcrttgtctcaggtctcagcactcanaatggatgctcataatcctacacacaatccccaaatgtcaatgaggatcattggccaaccatacctcagtgcatggggggtagtarggttatccattaaggccccaccttccacctcacaaatacttctgatcagagggatgagcttgggtaattttgggatgcatgacaggatgntgtcagcagactggccaaatccacattcagtatttcccatca

SEQ ID NO: 4094 - DNA, 198 bp, Artificial Sequence
  Description of Artificial Sequence: Synthetic polynucleotide
  modified_base (21)..(21): a, c, t, g, unknown or other
  modified_base (30)..(30): a, c, t, g, unknown or other
  modified_base (83)..(83): a, c, t, g, unknown or other
  modified_base (139)..(139): a, c, t, g, unknown or other
  modified_base (161)..(161): a, c, t, g, unknown or other
  modified_base (186)..(186): a, c, t, g, unknown or other
tatcaagtactttgtccattngcaggcagntgttaaatacagcagttggctcgtgtggatacagtactgcagagaaagayccnctctgtgaagatttgagcagcatggtcagtgaatgcagagaatgaggcaygatagnacctgtaatctccaaactaaantggtctctgtatccagaaagagctngtgtcttcacat

SEQ ID NO: 4095 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (351)..(351): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (737)..(737): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatrgaggaggaggaggagcccacactgccccagngtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4096 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacamgtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4097 - DNA, 375 bp, Artificial Sequence
  Description of Artificial Sequence: Synthetic polynucleotide
  modified_base (355)..(355): a, c, t, g, unknown or other
aaagaaaattaagcaacaattattcaagttgatgatttaatagtttttacrtatatctatgattgtcaagyagaattcagtattcayaggagaagtgaagaaagaaactaaaaagttcaagtcaacaagattcctgagttttagaaataaacaaatatatgtgcaaggtgtaatagttatgaagactaaagttaataaggcttcctggaaawaatataaaatatccccattgcaagagatayttttaagtgtaaaaagtattcttccaatgataagtttgtttactctgttaartcttcccttacgtatgattctatgataatargtactttactttaaaacaattgacaaatantgattacattcatttgatgt

SEQ ID NO: 4098 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcartcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4099 - DNA, 421 bp, Artificial Sequence
  Description of Artificial Sequence: Synthetic polynucleotide
  modified_base (9)..(9): a, c, t, g, unknown or other
  modified_base (27)..(27): a, c, t, g, unknown or other
  modified_base (49)..(49): a, c, t, g, unknown or other
  modified_base (67)..(67): a, c, t, g, unknown or other
  modified_base (123)..(123): a, c, t, g, unknown or other
  modified_base (145)..(145): a, c, t, g, unknown or other
  modified_base (155)..(155): a, c, t, g, unknown or other
  modified_base (183)..(183): a, c, t, g, unknown or other
  modified_base (190)..(190): a, c, t, g, unknown or other
  modified_base (196)..(196): a, c, t, g, unknown or other
  modified_base (316)..(316): a, c, t, g, unknown or other
  modified_base (320)..(320): a, c, t, g, unknown or other
  modified_base (324)..(324): a, c, t, g, unknown or other
  modified_base (334)..(334): a, c, t, g, unknown or other
  modified_base (346)..(346): a, c, t, g, unknown or other
  modified_base (372)..(372): a, c, t, g, unknown or other
  modified_base (378)..(378): a, c, t, g, unknown or other
  modified_base (382)..(382): a, c, t, g, unknown or other
gctttacanctttaaatataaatcacnatcatccaggtggcttacccangactaaggaaggtttccnacacaaggtggaggagaargtgctagaattcttatatgagaggacctcatggacantctcttgttggaatgttaggangttgggaganagtagargtagtagggcagtgctatgangtagttnttatcncagaactgcttttagctrgttatttaaatgagatggggaatagattaattgtccatatcaaagagtartggtaggattctaatgaaggtgagatgggaaaatctctctccaagccaagtnctgnatcnattaccaggntgtagaacattnaaaaaatgagatagattttataacancctgancctnactttatgaataaagagataaagagaaatgtgttgggca

SEQ ID NO: 4100 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacytacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4101 - DNA, 325 bp, Artificial Sequence
  Description of Artificial Sequence: Synthetic polynucleotide
  modified_base (73)..(73): a, c, t, g, unknown or other
  modified_base (169)..(169): a, c, t, g, unknown or other
  modified_base (182)..(182): a, c, t, g, unknown or other
  modified_base (252)..(252): a, c, t, g, unknown or other
gagcagcatttcaaggccctccatgctttggtctctgccaaatcactattasatttttaagatttttttttanacattatacttacattacacaatgtcttaacactatgaagtaaaaatgtaaatattttaaactctggcttggaaatgaggaggcagaatctcaganattttcctaaaanaaataggagaggcaagctttctgagtccacaaaagtgccctctacctattgggtcaaagaaaaagtaatntctctatttgtaacaacatacataaattataaaccctgaagaaataggtccctaatagctataatctttaaca

SEQ ID NO: 4102 - DNA, 500 bp, Artificial Sequence
  Description of Artificial Sequence: Synthetic polynucleotide
  modified_base (181)..(181): a, c, t, g, unknown or other
  modified_base (195)..(195): a, c, t, g, unknown or other
  modified_base (315)..(315): a, c, t, g, unknown or other
  modified_base (318)..(318): a, c, t, g, unknown or other
  modified_base (443)..(443): a, c, t, g, unknown or other
cagcatcagcatctctccacaagccttcccagagaaaagggctgctcagaccatcccgctgttagtgagctactgtctggtcatgtgctgggtggacctcatcatctcatcttcttcaaccctgctgtggacgtgtaacccagtcttcctgagtatgcagaaccttgtgggcgatgtctangccactgttgttcnactggaacaaatcagctctgataaaaatatagttgacattctccaaaatatgcaaagtgctataaagctttaacaagttggcgayggaaaacatttctaaaaaatagtcttctcctatanttnaattgttcaagtagccctggagttctttttatcttatttaataaaatgcatggaatcatacttttattatatttatatgctttcaaaactgatgcttctaaggaccatgtaatttctttaattcnagtgtctaccatgggttgacatttctgtatcaagtttcttacatttttattttcatt

SEQ ID NO: 4103 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccrgggagnagcccgtgtgcaaaggaggtgaaggatng

SEQ ID NO: 4104 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  modified_base (217)..(217): a, c, t, g, unknown or other
  modified_base (276)..(276): a, c, t, g, unknown or other
  modified_base (322)..(322): a, c, t, g, unknown or other
  modified_base (404)..(404): a, c, t, g, unknown or other
  modified_base (406)..(406): a, c, t, g, unknown or other
  modified_base (444)..(444): a, c, t, g, unknown or other
  modified_base (454)..(454): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaanaaagaaatttaagagatttactccaccaatctcttggtaatttttgtgttcattatcantaagctgtgtgcatccttttagagtgctactgtttgagaaaagcancattgaagttgctgctgatcttggtcatgcattttcagagygtgcttatcagcagacttggatgctgttggggttctstttntnatttgcaatttttccaagacaggctttctgttgcccangctggagtgngtagctgctgtttctcaatagacaagtcctagaagtagarataattcaattttcattcactcttagctcttctgc

SEQ ID NO: 4105 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (870)..(870): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacnaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgmcaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4106 - DNA, 243 bp, Artificial Sequence
  Description of Artificial Sequence: Synthetic polynucleotide
  modified_base (20)..(20): a, c, t, g, unknown or other
  modified_base (25)..(25): a, c, t, g, unknown or other
  modified_base (36)..(36): a, c, t, g, unknown or other
  modified_base (40)..(40): a, c, t, g, unknown or other
  modified_base (64)..(64): a, c, t, g, unknown or other
  modified_base (69)..(69): a, c, t, g, unknown or other
  modified_base (107)..(107): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (201)..(201): a, c, t, g, unknown or other
  modified_base (210)..(210): a, c, t, g, unknown or other
agactcatcaacttctcatnatcyntactaccacanacancagaatatctaaaacccctagagnccaanccactccagtccatgtttgagttttccaaatccacatncatttgaagngtngaattttccatgcantgtgttttgaaatcaacagacatatacttaatccttttgcctcartttctgatcatcataaagaynggaaaaacngaaatcctcagttcattttaattctcttagtcc

SEQ ID NO: 4107 - DNA, 92 bp, Artificial Sequence
  Description of Artificial Sequence: Synthetic oligonucleotide
  modified_base (11)..(11): a, c, t, g, unknown or other
  modified_base (27)..(27): a, c, t, g, unknown or other
  misc_feature (53)..(54): This region may encompass 'tg' or 'ca'
  modified_base (56)..(56): a, c, t, g, unknown or other
  modified_base (72)..(72): a, c, t, g, unknown or other
tcaagagtatngaggaatcataaacantccagaaggaggccctggtgtactayrcnaagtttttgccacatngctatgggaggaatctgtgt

SEQ ID NO: 4108 - DNA, 182 bp, Artificial Sequence
  Description of Artificial Sequence: Synthetic polynucleotide
  modified_base (12)..(12): a, c, t, g, unknown or other
  modified_base (61)..(61): a, c, t, g, unknown or other
  modified_base (120)..(120): a, c, t, g, unknown or other
  modified_base (157)..(157): a, c, t, g, unknown or other
cgcatgcctgancaataagcttggccagaaatacttcattaccatattgtttacwcattangaggtacgaagtagagatgagacttcatcaayatctcgaaggttttttgcagaacaacntaccaaattaggaagaatctcatgagcttttctgcangctatttcataaccttctatgacct

SEQ ID NO: 4109 - DNA, 529 bp, Artificial Sequence
  Description of Artificial Sequence: Synthetic polynucleotide
  modified_base (2)..(2): a, c, t, g, unknown or other
  modified_base (50)..(50): a, c, t, g, unknown or other
  modified_base (52)..(52): a, c, t, g, unknown or other
  modified_base (127)..(127): a, c, t, g, unknown or other
  modified_base (229)..(229): a, c, t, g, unknown or other
  modified_base (232)..(232): a, c, t, g, unknown or other
  modified_base (255)..(255): a, c, t, g, unknown or other
  modified_base (309)..(309): a, c, t, g, unknown or other
  modified_base (314)..(314): a, c, t, g, unknown or other
  modified_base (414)..(414): a, c, t, g, unknown or other
  modified_base (510)..(510): a, c, t, g, unknown or other
cnattcaaaaattaagccaataagaatcaacatataatccatgagattcncnatctaggkaagtaaacccaccctaatactgtgtttattaaaatgctgttaatgagatccgagrtttaaacaactnttcrctttagaaartgaaataaagctgactgaaataaaacctaatctatgaaattattctgtatatgaattgacctgaagtaatgaacagttcawtgactgnctnatractcttgttctggtccaggntaatcattctagttggcatactattaaacacacatttctgattgamacatctgntaaantaacatcaaacgacattacaaaatcaaaatggagactgctaagagtgggatttttctcctgccagtayctttcctttctgccacatyctcctccctgcynccacagyaatctttctraaggaatacaaatatattctgaatcacacgcaaacccctcaatacagaatgtgtggtaggcagtattctaaaatgcccncataccaccraccccacca

SEQ ID NO: 4110 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcsttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4111 - DNA, 1141 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  modified_base (194)..(194): a, c, t, g, unknown or other
  modified_base (211)..(211): a, c, t, g, unknown or other
  modified_base (231)..(231): a, c, t, g, unknown or other
  modified_base (254)..(254): a, c, t, g, unknown or other
  modified_base (287)..(287): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (331)..(331): a, c, t, g, unknown or other
  modified_base (356)..(356): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
  modified_base (394)..(394): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (443)..(443): a, c, t, g, unknown or other
  modified_base (458)..(458): a, c, t, g, unknown or other
  modified_base (476)..(476): a, c, t, g, unknown or other
  modified_base (488)..(488): a, c, t, g, unknown or other
  modified_base (498)..(498): a, c, t, g, unknown or other
  modified_base (512)..(512): a, c, t, g, unknown or other
  modified_base (525)..(525): a, c, t, g, unknown or other
  modified_base (534)..(534): a, c, t, g, unknown or other
  modified_base (536)..(536): a, c, t, g, unknown or other
  modified_base (569)..(569): a, c, t, g, unknown or other
  modified_base (636)..(636): a, c, t, g, unknown or other
  modified_base (640)..(640): a, c, t, g, unknown or other
  modified_base (654)..(654): a, c, t, g, unknown or other
  modified_base (656)..(656): a, c, t, g, unknown or other
  modified_base (667)..(667): a, c, t, g, unknown or other
  modified_base (669)..(669): a, c, t, g, unknown or other
  modified_base (676)..(676): a, c, t, g, unknown or other
  modified_base (719)..(756): a, c, t, g, unknown or other
  modified_base (758)..(822): a, c, t, g, unknown or other
  modified_base (844)..(844): a, c, t, g, unknown or other
  modified_base (865)..(865): a, c, t, g, unknown or other
  modified_base (873)..(873): a, c, t, g, unknown or other
  modified_base (883)..(883): a, c, t, g, unknown or other
  modified_base (887)..(887): a, c, t, g, unknown or other
  modified_base (892)..(892): a, c, t, g, unknown or other
  modified_base (923)..(923): a, c, t, g, unknown or other
  modified_base (932)..(932): a, c, t, g, unknown or other
  modified_base (938)..(938): a, c, t, g, unknown or other
  modified_base (940)..(940): a, c, t, g, unknown or other
  modified_base (954)..(954): a, c, t, g, unknown or other
  modified_base (973)..(973): a, c, t, g, unknown or other
  modified_base (978)..(978): a, c, t, g, unknown or other
  modified_base (986)..(986): a, c, t, g, unknown or other
  modified_base (1000)..(1000): a, c, t, g, unknown or other
  modified_base (1010)..(1094): a, c, t, g, unknown or other
  modified_base (1096)..(1114): a, c, t, g, unknown or other
  modified_base (1135)..(1135): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttantattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcntccactaaccagaagcatgtcccagctctcttctgtgtcccaccattagaaaatcaaaagctgactntagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaanatacaccnttgatcatantgtntctcnaycaaaagcttcaatggtcaagtactgaacnttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 4112 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatayaagcagcctngaaaaatcnctctagaggagaaaagacaggaagaatgtcatcnagaaagaaggccaggagangatgcnacaaaggtgcttttyctccctcctcnctt

SEQ ID NO: 4113 - DNA, 325 bp, Artificial Sequence
  Description of Artificial Sequence: Synthetic polynucleotide
  misc_feature (97)..(98): This region may encompass 'tg' or 'ca'
  modified_base (175)..(175): a, c, t, g, unknown or other
  modified_base (205)..(205): a, c, t, g, unknown or other
  modified_base (228)..(228): a, c, t, g, unknown or other
  modified_base (269)..(269): a, c, t, g, unknown or other
  modified_base (271)..(271): a, c, t, g, unknown or other
  modified_base (288)..(288): a, c, t, g, unknown or other
aattatttctttttgttgataagaatatgatattttgttggtaagaataggacatatggccttgcttagaagaaaggtgactaagaattgtagttcyrgaaggggagctattttccagtaacagctctacactctagaagaagatataagaaaattgatgaatacttagttcccngtaatttactctgtctcctataatctgagnttttaatttctccagtgcagtgnttatctgattatcctttgtagataatttcctttgtaagtananttctgtactagggagancttcacttttcttctttgtctactaacatacttcagg

SEQ ID NO: 4114 - DNA, 186 bp, Artificial Sequence
  Description of Artificial Sequence: Synthetic polynucleotide
  modified_base (57)..(57): a, c, t, g, unknown or other
  modified_base (102)..(102): a, c, t, g, unknown or other
  modified_base (137)..(137): a, c, t, g, unknown or other
  modified_base (141)..(141): a, c, t, g, unknown or other
  modified_base (159)..(159): a, c, t, g, unknown or other
  modified_base (162)..(162): a, c, t, g, unknown or other
  modified_base (164)..(164): a, c, t, g, unknown or other
  modified_base (172)..(172): a, c, t, g, unknown or other
gaaacgrgtgaaagtgcagactgttatctagagatgtaagtgtatgttctggasggngaaygggtctcattctgggcactgggaggcacatttaagaaaycncaaatcaaaatagtgtcatcatgggagctgctganratntgaaactcatcaaactgnagncnaaacacangtccagaatgttcc

SEQ ID NO: 4115 - DNA, 190 bp, Artificial Sequence
  Description of Artificial Sequence: Synthetic polynucleotide
  modified_base (48)..(48): a, c, t, g, unknown or other
  modified_base (85)..(85): a, c, t, g, unknown or other
gcagtgtgccaggtgattgggatgtacgactacaccgcgcagaatgangatgagctggccttcaacaagggccagatcatcaacntcctcaacaaggaggacccygactggtggaaaggagaagtcaatggacaagtggggctcttcccatccaattatgtgaagytgaccacagacatggacccaagcc

SEQ ID NO: 4116 - DNA, 167 bp, Artificial Sequence
  Description of Artificial Sequence: Synthetic polynucleotide
  modified_base (12)..(12): a, c, t, g, unknown or other
  modified_base (50)..(50): a, c, t, g, unknown or other
  modified_base (123)..(123): a, c, t, g, unknown or other
  modified_base (135)..(135): a, c, t, g, unknown or other
  modified_base (143)..(143): a, c, t, g, unknown or other
  modified_base (146)..(146): a, c, t, g, unknown or other
  modified_base (157)..(157): a, c, t, g, unknown or other
gagaagatcaangtctgtggtaagaagacgaagcttcagtatctcmccantcagattaaggcgatcaagaacacccttragaagaaggtttagcagatctcccatccgtcgtaaaagatccangtcttctgaacnaggcagancanccaaacgtctnacagatttgg

SEQ ID NO: 4117 - DNA, 346 bp, Artificial Sequence
  Description of Artificial Sequence: Synthetic polynucleotide
  modified_base (12)..(12): a, c, t, g, unknown or other
  modified_base (29)..(29): a, c, t, g, unknown or other
  modified_base (46)..(46): a, c, t, g, unknown or other
  modified_base (87)..(87): a, c, t, g, unknown or other
  modified_base (119)..(119): a, c, t, g, unknown or other
  modified_base (140)..(140): a, c, t, g, unknown or other
  modified_base (177)..(177): a, c, t, g, unknown or other
  modified_base (187)..(187): a, c, t, g, unknown or other
  modified_base (218)..(218): a, c, t, g, unknown or other
  modified_base (222)..(222): a, c, t, g, unknown or other
  modified_base (237)..(237): a, c, t, g, unknown or other
  modified_base (255)..(255): a, c, t, g, unknown or other
  modified_base (258)..(258): a, c, t, g, unknown or other
  modified_base (281)..(281): a, c, t, g, unknown or other
  modified_base (303)..(303): a, c, t, g, unknown or other
  modified_base (309)..(309): a, c, t, g, unknown or other
  modified_base (311)..(311): a, c, t, g, unknown or other
cataaagcagtntatttttcttaaaaagnaaggtacatggtcacantccaaaatgttttatacagctctcagcytggaaaatgcaantratgaaaaaggcactgtttctagaacaratngaaaaagaataaatatgtcancatttaccctgcacagctttgagtaacaccataggancctgtcacangttcagggtcaattttaaaagcttgagaagnacanagcaaggtgatgtcntagactagccaggctccnaanggaagagctgtctgtccctcctnmactgtcctctctctgtcacangtgtcntntcactgttcctctagcagatgtggaaagtggctgc

SEQ ID NO: 4118 - DNA, 469 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (29)..(29): a, c, t, g, unknown or other
  modified_base (31)..(31): a, c, t, g, unknown or other
  modified_base (39)..(39): a, c, t, g, unknown or other
  modified_base (57)..(57): a, c, t, g, unknown or other
  modified_base (92)..(92): a, c, t, g, unknown or other
  modified_base (99)..(99): a, c, t, g, unknown or other
  modified_base (105)..(105): a, c, t, g, unknown or other
  modified_base (137)..(137): a, c, t, g, unknown or other
  modified_base (143)..(143): a, c, t, g, unknown or other
  modified_base (150)..(150): a, c, t, g, unknown or other
  modified_base (170)..(170): a, c, t, g, unknown or other
  modified_base (173)..(173): a, c, t, g, unknown or other
  modified_base (179)..(179): a, c, t, g, unknown or other
  modified_base (214)..(214): a, c, t, g, unknown or other
  modified_base (230)..(230): a, c, t, g, unknown or other
  modified_base (252)..(252): a, c, t, g, unknown or other
  modified_base (258)..(258): a, c, t, g, unknown or other
  modified_base (277)..(277): a, c, t, g, unknown or other
  modified_base (318)..(318): a, c, t, g, unknown or other
  modified_base (323)..(323): a, c, t, g, unknown or other
  modified_base (325)..(325): a, c, t, g, unknown or other
  modified_base (340)..(340): a, c, t, g, unknown or other
  modified_base (343)..(343): a, c, t, g, unknown or other
  modified_base (346)..(346): a, c, t, g, unknown or other
  modified_base (355)..(355): a, c, t, g, unknown or other
  modified_base (361)..(361): a, c, t, g, unknown or other
  modified_base (382)..(382): a, c, t, g, unknown or other
  modified_base (395)..(395): a, c, t, g, unknown or other
  modified_base (402)..(402): a, c, t, g, unknown or other
  modified_base (407)..(407): a, c, t, g, unknown or other
  modified_base (410)..(410): a, c, t, g, unknown or other
  modified_base (412)..(412): a, c, t, g, unknown or other
  modified_base (423)..(423): a, c, t, g, unknown or other
  modified_base (425)..(425): a, c, t, g, unknown or other
  modified_base (453)..(453): a, c, t, g, unknown or other
  modified_base (467)..(467): a, c, t, g, unknown or other
agcctgacnacacatttnccaaaagcagntnaaaaaaangcaagggtctcaggctcngtcacatccaactcattcttatgtgccagggaganacagagnacattntgtgtatctgttrgattgtgaatyaccacttngcatanagactgntctcaacagtgagattcycntcntgtagnaccctcatgcttcagctaggtgcttacaggtgaanagttactcaaaaatcntcatgtagcaaatttggtttcnaccttnaattagagagactcaggcntgcaccaaggaaaygtctagctatgctcttctccagcctcncaccngnctgcrggtcttagcnttnttngtatcactnggtgtnccgggcttttgtttgaatggncaacctggctgcnatcattngcagnccnantcgctctgccngntctgcaytgtctgcttcaaaagtcaggntcaccagagagagnaa

SEQ ID NO: 4119 - DNA, 610 bp, Artificial Sequence
  Description of Artificial Sequence: Synthetic polynucleotide
  modified_base (44)..(44): a, c, t, g, unknown or other
  modified_base (160)..(160): a, c, t, g, unknown or other
  modified_base (227)..(227): a, c, t, g, unknown or other
  modified_base (350)..(350): a, c, t, g, unknown or other
  modified_base (356)..(356): a, c, t, g, unknown or other
  modified_base (496)..(526): a, c, t, g, unknown or other
  modified_base (543)..(543): a, c, t, g, unknown or other
  modified_base (592)..(592): a, c, t, g, unknown or other
  modified_base (602)..(602): a, c, t, g, unknown or other
tatttactttggtaccaattctagatatayatctgcatataccnggtatttaacttcctggtctcatgttccttaaatagttaataagaaagagtaattatgaaccatgcagascaattaacaagcctaacttccaatattttcttcactctgaartaantatttccaacaktgtattatgtcagaagttctcrgttttgggggtgctgtatcttaatttttctgtnctctaktttcaacttcactgamataatacaagctctatcttccttacaaatttataaggaatcaaatgaaatgaaatatataaaagttgtcytctttctcccatcttcaaaaaacttcccccngcaytncatttcctgttarccctctctccttcaacagcctggtctgtagaaagagtccatacatggcctccctccactscctcatcttccattcaytccttgttccaaggycctcccaacaccactgaaacttttttcaatgcccnnnnnnnnnnnnnnnnnnnnnnnnnnnnnnngcaaattctgcccccancttttcattctttcagttgaaccactttttccaaaacactgtgcagatntaaaaaatangtagttaa

SEQ ID NO: 4120 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggyatgtatgatgcaagcaagtttttagtttaaagctaaggaattaaaatgaaaacaatacatagtgctctctgta

SEQ ID NO: 4121 - DNA, 250 bp, Artificial Sequence
  Description of Artificial Sequence: Synthetic polynucleotide
  modified_base (14)..(49): a, c, t, g, unknown or other
  modified_base (51)..(51): a, c, t, g, unknown or other
  modified_base (107)..(107): a, c, t, g, unknown or other
  modified_base (160)..(160): a, c, t, g, unknown or other
  modified_base (218)..(218): a, c, t, g, unknown or other
cacatcatgtatannnnnnnnnnnnnnnnnnnnnnnnnnnnnnnnnnnntnctttagaaaagagactaaattctttaaaatattttacatagtccttaaaatttgtnttygattttcgcttcactcttattactctctcaccattaccctaaactcaatnggagttctaattccaagaaacattcatagctccttgatgtgtgcactctcatttccangtctctgaaaatgtttctttcacragtttctc

SEQ ID NO: 4122 - DNA, 664 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  misc_feature (369)..(370): This region may encompass 'tc' or 'at'
  modified_base (407)..(407): a, c, t, g, unknown or other
  modified_base (449)..(449): a, c, t, g, unknown or other
  modified_base (511)..(511): a, c, t, g, unknown or other
  modified_base (531)..(531): a, c, t, g, unknown or other
  modified_base (580)..(580): a, c, t, g, unknown or other
  modified_base (597)..(597): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacwytatctgtgggaaaagcatttttagtagaatgcttgcncatcttcctacattcctgtaatcaaacagtatttatcatcanctatgttggtgactctcactttgacataggctgaaccagaaatcctaggaaaaactgatganagaaagctaaggggaagganaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4123 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcataraanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4124 - DNA, 400 bp, Artificial Sequence
  Description of Artificial Sequence: Synthetic polynucleotide
  modified_base (182)..(182): a, c, t, g, unknown or other
  modified_base (268)..(268): a, c, t, g, unknown or other
acagtcaagaagcwgataggtgactgctattcccctctygctgaaaacgcagccacttggagtcagcttgatggcagtggtggctcaggccttgaacacgtgagaatagactatgttgtcaagatgctgatgaaccgcacttctgcctgacttgrtgcrttgtctcaggtctcagcactcanaatggatgctcataatcctacacacaatccccaaatgtcaatgaggatcattggccaaccatacctcagtgcatggggggtagtanggttatccattaaggccccaccttccacctcacaaatacttctgatcagagggatgagcttgggtaattttgggatgcatgacaggatgrtgtcagcagactggccaaatccacattcagtatttcccatca

SEQ ID NO: 4125 - DNA, 663 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (240)..(240): a, c, t, g, unknown or other
  modified_base (336)..(336): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (593)..(593): a, c, t, g, unknown or other
  modified_base (596)..(596): a, c, t, g, unknown or other
  modified_base (601)..(601): a, c, t, g, unknown or other
  modified_base (614)..(614): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccngtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagrgaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggnggtaagagggctcgccagagccagnaggngngngggcagggtccctgtg

SEQ ID NO: 4126 - DNA, 171 bp, Artificial Sequence
  Description of Artificial Sequence: Synthetic polynucleotide
  modified_base (45)..(45): a, c, t, g, unknown or other
  modified_base (73)..(73): a, c, t, g, unknown or other
  modified_base (158)..(158): a, c, t, g, unknown or other
actggtttattagtccctcctagctcaacctctaatttgttctcntggagcactgcagagaagtcaaaacacnattctgaatgacgagccctggtcattaaccctgattctcagaagttgtcatcttccrgattctgcagtctctgtgcctttgcagnctgccttcctggg

SEQ ID NO: 4127 - DNA, 131 bp, Artificial Sequence
  Description of Artificial Sequence: Synthetic polynucleotide
  modified_base (119)..(119): a, c, t, g, unknown or other
catccacaaactttgtcacacagagttctgtgaggttaagcaccacctaaatacttttcamccacttaagaggaggaaaatgcatactcctgcttaaaacatttacatttaatatgtcngaaaacacctaa

SEQ ID NO: 4128 - DNA, 669 bp, Artificial Sequence
  Description of Artificial Sequence: Synthetic polynucleotide
  modified_base (51)..(51): a, c, t, g, unknown or other
  modified_base (112)..(112): a, c, t, g, unknown or other
  modified_base (116)..(162): a, c, t, g, unknown or other
  modified_base (170)..(170): a, c, t, g, unknown or other
  modified_base (223)..(223): a, c, t, g, unknown or other
  modified_base (229)..(229): a, c, t, g, unknown or other
  modified_base (435)..(435): a, c, t, g, unknown or other
  modified_base (537)..(537): a, c, t, g, unknown or other
  modified_base (629)..(658): a, c, t, g, unknown or other
aaaacagtaaatttttatgatagttttaaagttactaagattgagaatatntcaatttttcactgctcatgaatctgtgggttccttaaacaattatacataaggtctatanatannnnnnnnnnnnnnnnnnnnnnnnnnnnnnnnnnnnnnnnnnnnnnnaatggctnagaatcttgcctaacatattgtatgcactaagcaagtactagtaaaattattnatcaanttatcatcttcataccattcttcaaatggcatattgtttgttctaattaaaaactatgtttctgtcttatgttaagtagcaacaaaaattagaaggtctacttgttctgccctcttgagaaaatccaaagttaaatggtagttttactaatttcctttagattcagtaccttattttcctcacacaaaaatgtaaacattaagganaacatcatatttaaatgattcatcctacaatagacagacttygggtcattcattgattgggctgaagtctcactcactctctattatttctaattttttcangttaacagcctagaaaatctactacacatggaatgttataaattagaaattaacaccttggatgtacaaattataaaagtaaactgaaaagnnnnnnnnnnnnnnnnnnnnnnnnnnnnnnggattgttatt

SEQ ID NO: 4129 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1028)..(1028): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1729)..(1729): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacrtgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4130 - DNA, 97 bp, Artificial Sequence
  Description of Artificial Sequence: Synthetic oligonucleotide
  modified_base (2)..(2): a, c, t, g, unknown or other
  modified_base (28)..(28): a, c, t, g, unknown or other
  modified_base (48)..(48): a, c, t, g, unknown or other
  modified_base (77)..(77): a, c, t, g, unknown or other
  modified_base (82)..(82): a, c, t, g, unknown or other
  modified_base (85)..(85): a, c, t, g, unknown or other
gngcagaatgtttcctgttctcagtgcnaagacactggttttcaatcngygtctaaaaccacgttcctgcctttcantgcanacngtgtgttcattt

SEQ ID NO: 4131 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagrctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4132 - DNA, 401 bp, Artificial Sequence
  Description of Artificial Sequence: Synthetic polynucleotide
  misc_feature (42)..(43): This region may encompass 'ca' or is absent in its entirety
  modified_base (104)..(104): a, c, t, g, unknown or other
  modified_base (108)..(108): a, c, t, g, unknown or other
  modified_base (122)..(184): a, c, t, g, unknown or other
  modified_base (310)..(310): a, c, t, g, unknown or other
  modified_base (355)..(355): a, c, t, g, unknown or other
  modified_base (367)..(367): a, c, t, g, unknown or other
  modified_base (375)..(375): a, c, t, g, unknown or other
  modified_base (396)..(396): a, c, t, g, unknown or other
gcacattatttcctgaatacctattaccacacccaaatacccatttagttgttgaatattacttttacccatatgcttacaagaaacttctgttacataatcanttanttacagcacaactnnnnnnnnnnnnnnnnnnnnnnnnnnnnnnnnnnnnnnnnnnnnnnnnnnnnnnnnnnnnnnntgaatcaagtcttattgaacatattttaagtgaaggacttactgctaaaatcacttttaaatggctctttaagtgataggcatttaaaataaatcattaatctaacaatggaagcatcataaattngttcatttttgatagaaaggacataactgggatgttatgtttctntaagasagtacnagtatttntctttcaaaatatgtacattnaaraa

SEQ ID NO: 4133 - DNA, 3744 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  misc_feature (1679)..(1682): This region may encompass 'aaaa' or is absent in its entirety
  modified_base (1714)..(1714): a, c, t, g, unknown or other
  modified_base (1789)..(1789): a, c, t, g, unknown or other
  modified_base (1920)..(1963): a, c, t, g, unknown or other
  modified_base (2085)..(2085): a, c, t, g, unknown or other
  modified_base (2090)..(2090): a, c, t, g, unknown or other
  modified_base (2401)..(2401): a, c, t, g, unknown or other
  modified_base (2471)..(2471): a, c, t, g, unknown or other
  modified_base (2744)..(2744): a, c, t, g, unknown or other
  modified_base (2746)..(2746): a, c, t, g, unknown or other
  modified_base (2797)..(2797): a, c, t, g, unknown or other
  modified_base (2803)..(2803): a, c, t, g, unknown or other
  modified_base (2828)..(2828): a, c, t, g, unknown or other
  modified_base (2844)..(2844): a, c, t, g, unknown or other
  modified_base (2869)..(2869): a, c, t, g, unknown or other
  modified_base (2982)..(2982): a, c, t, g, unknown or other
  modified_base (2995)..(2995): a, c, t, g, unknown or other
  modified_base (2997)..(2997): a, c, t, g, unknown or other
  modified_base (3024)..(3024): a, c, t, g, unknown or other
  modified_base (3050)..(3050): a, c, t, g, unknown or other
  modified_base (3077)..(3077): a, c, t, g, unknown or other
  modified_base (3229)..(3229): a, c, t, g, unknown or other
  modified_base (3255)..(3255): a, c, t, g, unknown or other
  modified_base (3266)..(3266): a, c, t, g, unknown or other
  modified_base (3270)..(3270): a, c, t, g, unknown or other
  modified_base (3272)..(3272): a, c, t, g, unknown or other
  modified_base (3381)..(3381): a, c, t, g, unknown or other
  modified_base (3427)..(3427): a, c, t, g, unknown or other
  modified_base (3470)..(3470): a, c, t, g, unknown or other
  modified_base (3515)..(3515): a, c, t, g, unknown or other
  modified_base (3540)..(3540): a, c, t, g, unknown or other
  modified_base (3554)..(3554): a, c, t, g, unknown or other
  modified_base (3560)..(3560): a, c, t, g, unknown or other
  modified_base (3619)..(3619): a, c, t, g, unknown or other
  modified_base (3744)..(3744): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttaaaaagaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4134 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccwctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4135 - DNA, 237 bp, Artificial Sequence
  Description of Artificial Sequence: Synthetic polynucleotide
  modified_base (4)..(4): a, c, t, g, unknown or other
  modified_base (47)..(47): a, c, t, g, unknown or other
  modified_base (59)..(59): a, c, t, g, unknown or other
  modified_base (69)..(69): a, c, t, g, unknown or other
  modified_base (93)..(93): a, c, t, g, unknown or other
  modified_base (97)..(97): a, c, t, g, unknown or other
  modified_base (120)..(120): a, c, t, g, unknown or other
  modified_base (129)..(129): a, c, t, g, unknown or other
  modified_base (132)..(132): a, c, t, g, unknown or other
  modified_base (140)..(140): a, c, t, g, unknown or other
  modified_base (150)..(150): a, c, t, g, unknown or other
  modified_base (169)..(169): a, c, t, g, unknown or other
  modified_base (188)..(188): a, c, t, g, unknown or other
  modified_base (199)..(199): a, c, t, g, unknown or other
  modified_base (215)..(215): a, c, t, g, unknown or other
  modified_base (231)..(231): a, c, t, g, unknown or other
ctgntgggcaaagttttcttaaccagagagcttcctggcccacasangaaaggaaaaantaatgatccntcagctgtttctgaacttcagganagtnggaggcccagcttcagkgatcangtctkctgngangtcacaanggaaattacnccttcaagaatgcactgtnagccatatccttgactccnatgaatcaatnaggaaagggctattgntataaataagcaaatnagactg

SEQ ID NO: 4136 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (444)..(444): a, c, t, g, unknown or other
  modified_base (478)..(478): a, c, t, g, unknown or other
  modified_base (483)..(483): a, c, t, g, unknown or other
  modified_base (562)..(562): a, c, t, g, unknown or other
  modified_base (656)..(656): a, c, t, g, unknown or other
  modified_base (696)..(696): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggnctagccattaaagctgatgtctcttagttgcaancccancctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaaganaygtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4137 - DNA, 150 bp, Artificial Sequence
  Description of Artificial Sequence: Synthetic polynucleotide
gaattcttatcagtactaagtatgaacatgayyttatcaatattttcattactaattatacaataagaamctgacttctgactattctaaggtataaatgtgtactttaycttaaataggaaaatgtgttgtatatccattttgagattc

SEQ ID NO: 4138 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggratctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4139 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccrttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4140 - DNA, 511 bp, Artificial Sequence
  Description of Artificial Sequence: Synthetic polynucleotide
  modified_base (103)..(103): a, c, t, g, unknown or other
  misc_feature (153)..(153): May or may not be present
  modified_base (236)..(236): a, c, t, g, unknown or other
aaacatcagagcayttaattctgacttggtgtaaggtgtatatcttatgtttgaacccactcttcctgtgggttttgttttaaaagaaatgactactattttntcttctcctgtagctatttctggaccctttgtggtttaagaaggaatacagggaggagaaagagaaaaaaaatgaaatcatccaggcaaggaagtttagaaagcagaggtttaggagaagaaaaagaagagangtttctggyagcttcctgattttagaagctgattttgctacttttctttaattctgaggtagtttcaartattttgttgttacctttctggaaagaaataagtttatcrtttctacttttggatgtttttaggtgccagctaaaatacaaccctcatttattttccttgatgcagaaacctaacttctctaatttagcatacgagaagaccagtttgggaatatttaaagttcttcactttgggaaccttagatgttggtcgtccttagtaaaat

SEQ ID NO: 4141 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcycggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4142 - DNA, 423 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (38)..(38): a, c, t, g, unknown or other
  modified_base (42)..(42): a, c, t, g, unknown or other
  modified_base (53)..(53): a, c, t, g, unknown or other
  modified_base (72)..(72): a, c, t, g, unknown or other
  modified_base (87)..(87): a, c, t, g, unknown or other
  modified_base (91)..(91): a, c, t, g, unknown or other
  modified_base (101)..(101): a, c, t, g, unknown or other
  modified_base (111)..(111): a, c, t, g, unknown or other
  modified_base (159)..(159): a, c, t, g, unknown or other
  modified_base (168)..(168): a, c, t, g, unknown or other
  modified_base (184)..(184): a, c, t, g, unknown or other
  modified_base (196)..(196): a, c, t, g, unknown or other
  modified_base (224)..(224): a, c, t, g, unknown or other
  modified_base (229)..(229): a, c, t, g, unknown or other
  modified_base (232)..(232): a, c, t, g, unknown or other
  modified_base (234)..(234): a, c, t, g, unknown or other
  modified_base (237)..(237): a, c, t, g, unknown or other
  modified_base (241)..(241): a, c, t, g, unknown or other
  modified_base (272)..(272): a, c, t, g, unknown or other
  modified_base (275)..(275): a, c, t, g, unknown or other
  modified_base (291)..(291): a, c, t, g, unknown or other
  modified_base (296)..(296): a, c, t, g, unknown or other
  modified_base (299)..(299): a, c, t, g, unknown or other
  modified_base (313)..(313): a, c, t, g, unknown or other
  modified_base (322)..(322): a, c, t, g, unknown or other
  modified_base (347)..(347): a, c, t, g, unknown or other
  modified_base (358)..(358): a, c, t, g, unknown or other
  modified_base (409)..(409): a, c, t, g, unknown or other
ggtcnagcgatggngccttcctggccatttcttccacngacngttactgctcntttgtgacatttgagaaantgaacttggaattcntttnaaagagaagncagttttgancatgagaactcctgatacagcaaagaaaaccaagagtcagacacaycnagggtcttngccaggacccagaccngtagagggaacnctgccagcagaacccaagaccccagcanccccngcncnacnccynctcaggccagacaggccccagccccaacagncancagggaccctccctcnatcantcntgctgtcaaaagcnccttgccgnggccttcggaggagaagaccctgcngcccagtagtnaaaacacaaaagcccayccatcccggagggtcactctgaacacactgcaancctggagcaagaca

SEQ ID NO: 4143 - DNA, 149 bp, Artificial Sequence
  Description of Artificial Sequence: Synthetic polynucleotide
  modified_base (19)..(19): a, c, t, g, unknown or other
  modified_base (42)..(42): a, c, t, g, unknown or other
  modified_base (44)..(44): a, c, t, g, unknown or other
  modified_base (67)..(67): a, c, t, g, unknown or other
  modified_base (73)..(73): a, c, t, g, unknown or other
  modified_base (108)..(108): a, c, t, g, unknown or other
  modified_base (116)..(116): a, c, t, g, unknown or other
  modified_base (120)..(120): a, c, t, g, unknown or other
tgaaagaacatggtgttgngaaaagaaagagcagttacacantngaacagttggaacaggtgtttgntcaggnaggatgggatgctcagccctgccagmctgtacttnttaacagnagtngcttgtaccaggagctggagtcagatggc

SEQ ID NO: 4144 - DNA, 200 bp, Artificial Sequence
  Description of Artificial Sequence: Synthetic polynucleotide
  modified_base (127)..(127): a, c, t, g, unknown or other
taaagcattttattcagatcaaaagccctagagaaaaatggcactgaaaatataatataaaattttcatcccaaagcttttcaaacatattatttgaatactcttagccctttcacagcatttgatncrttgacttgccaccttaccatttaagttaaaagtaatagtatttatgttgtagtccagtatagcacactgac

SEQ ID NO: 4145 - DNA, 183 bp, Artificial Sequence
  Description of Artificial Sequence: Synthetic polynucleotide
  modified_base (12)..(12): a, c, t, g, unknown or other
  misc_feature (61)..(62): This region may encompass 'tg' or 'ca'
  modified_base (94)..(94): a, c, t, g, unknown or other
  modified_base (121)..(121): a, c, t, g, unknown or other
  modified_base (158)..(158): a, c, t, g, unknown or other
cgcatgcctgancaataagcttggccagaaatacttcattaccatattgtttacwcattayrgaggtacgaagtagagatgagacttcatcaanatctcgaaggttttttgcagaacaacntaccaaattaggaagaatctcatgagcttttctgcangctatttcataaccttctatgacct

SEQ ID NO: 4146 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttkccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4147 - DNA, 201 bp, Artificial Sequence
  Description of Artificial Sequence: Synthetic polynucleotide
  modified_base (11)..(11): a, c, t, g, unknown or other
  modified_base (15)..(15): a, c, t, g, unknown or other
  modified_base (32)..(32): a, c, t, g, unknown or other
  modified_base (42)..(64): a, c, t, g, unknown or other
  modified_base (79)..(79): a, c, t, g, unknown or other
  modified_base (165)..(165): a, c, t, g, unknown or other
aggaaagtaanaaangggtgaagaggagaagnttccaaaacnnnnnnnnnnnnnnnnnnnnnnngggaatcacaggagnctataaaggaactatttaaatatcatgatactccccaaagtctcagatagscaatctcatgaattgcaaaagccaattaaaaaacnaacttcgttaagtgaattcatcttgctatggtagtt

SEQ ID NO: 4148 - DNA, 83 bp, Artificial Sequence
  Description of Artificial Sequence: Synthetic oligonucleotide
  modified_base (60)..(60): a, c, t, g, unknown or other
gatggaaggagtggtagtgttagaggytcaccttgtcatgctggtcactgggtggcaggngctggtttcggcaaaggcacaac

SEQ ID NO: 4149 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcmttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4150 - DNA, 740 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (211)..(211): a, c, t, g, unknown or other
  modified_base (214)..(214): a, c, t, g, unknown or other
  modified_base (229)..(229): a, c, t, g, unknown or other
  modified_base (403)..(403): a, c, t, g, unknown or other
  modified_base (411)..(411): a, c, t, g, unknown or other
  modified_base (421)..(421): a, c, t, g, unknown or other
  modified_base (739)..(739): a, c, t, g, unknown or other
acaaaactcagggnctggaatggagatatccttctnttctcaataaatgcatcaggacaaactgatgggagtggaagtaataagcagcctaggttttcctcyctgtatctcatgctctgtgtcacagacgtgtcctctggaggacagagcacttctcctatgtaactctgaaagaagtaacatttttctgacttccaaaatacttttgctntanttcaattcagaaaantaaaatccactaaggaacatatttgaagaacactacaaatcacctgtagggaacccatagaaacacattaggaaatgtgatattgtgttgtgcacattttgaaggctggattattgggaggtatattttgttgacaagttctgagaacatacaatycattaggcagaagctacntagaaaantgagctttcncattaaaaagtwtggaacccagatggtacaatraaagtttagaaattgtacactctgtggctgtgttgatgttttatattatttgatgtgkaaatgagtgaagaggcyagattatccagaatgtacctgagataatcagagataaccaaggagaaggtaaaattaaaatgatsgtggtaattatttggagcactaaagaacaaacattgataatgygagatctgttttttcccagatacatgaaatacatttctttgtyattaagatgaacatactttaagcayaatgcttctgttatgcttaaaaataccttttttnc

SEQ ID NO: 4151 - DNA, 125 bp, Artificial Sequence
  Description of Artificial Sequence: Synthetic polynucleotide
  modified_base (4)..(4): a, c, t, g, unknown or other
  modified_base (26)..(26): a, c, t, g, unknown or other
  modified_base (60)..(60): a, c, t, g, unknown or other
  modified_base (62)..(62): a, c, t, g, unknown or other
  modified_base (100)..(100): a, c, t, g, unknown or other
tttnggattcaggttttattaatgtnctttcattgcaaaatgtttccaattataaaacantncrgagagctctgcattaataaacttgcctgtctttcanaagggccagagattttgaaatgcct

SEQ ID NO: 4152 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaawcattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4153 - DNA, 175 bp, Artificial Sequence
  Description of Artificial Sequence: Synthetic polynucleotide
  modified_base (32)..(32): a, c, t, g, unknown or other
  modified_base (44)..(44): a, c, t, g, unknown or other
  modified_base (84)..(84): a, c, t, g, unknown or other
  modified_base (90)..(90): a, c, t, g, unknown or other
  modified_base (103)..(103): a, c, t, g, unknown or other
  modified_base (146)..(146): a, c, t, g, unknown or other
  modified_base (171)..(171): a, c, t, g, unknown or other
ttctttggcaatggaacattataagstgcagnaccaagaaccanctcgaagagtttgtctgagtaaggtatggttttctctacnctttcncggaaatgggaancccatttggcatatasgatagtgccaccaatacctccaccaanaaacaaaaggccagctccagcaatnttgc

SEQ ID NO: 4154 - DNA, 766 bp, Artificial Sequence
  Description of Artificial Sequence: Synthetic polynucleotide
  misc_feature (134)..(136): This region may encompass 'cct' or is absent in its entirety
  modified_base (185)..(185): a, c, t, g, unknown or other
  modified_base (200)..(200): a, c, t, g, unknown or other
  modified_base (269)..(269): a, c, t, g, unknown or other
  modified_base (344)..(344): a, c, t, g, unknown or other
  modified_base (393)..(393): a, c, t, g, unknown or other
  modified_base (417)..(417): a, c, t, g, unknown or other
  modified_base (563)..(563): a, c, t, g, unknown or other
  modified_base (598)..(598): a, c, t, g, unknown or other
tatttttaaatgctgaaaaatgaaatactaaattatttatgaatakataacttcaataaaagatgagaaaatacaactaggtcattaggacaatttgtatgaaacaatatccaatttgctgtctgttacttctcctaccttatcatgtctaatttttcctcatctttgtgaaatcctgcrtctanaataggcaaraaaancaaaaaacaaaaggaatcttattctattcacagccatcagaaaaatgtgttactattcctgtagtcagngttctaaatcatacatttgagatatatytsaaacatgtcataaagaaaataagcatcatatttctmactaaatancacctgaaatattccatatgaaaggaaaaatacraaaaactaaactttnaattactaacctccttaaaggaanataattctatatgatttgatatttsataatggatgtccaatacctgagatataaattccattttctgtgtcctaacatctcaccttcagaaaatctccaatattgggttatttggattatatatttaaaactgaatatacttgaanatgtgaawgatttgttgchrcaacaaatggtttancaattatctgcattaaaatgtgttccatgaacaacagaaaaagaatatttctacttcagtccttaaaaattgtgaaagcacasccacagtcttagtttgtcgatctysaattcttttggtattttaatttcaccaataattcyggaactgctgtttttrtatttctca

SEQ ID NO: 4155 - DNA, 793 bp, Artificial Sequence
  Description of Artificial Sequence: Synthetic polynucleotide
  modified_base (9)..(9): a, c, t, g, unknown or other
  modified_base (61)..(61): a, c, t, g, unknown or other
  modified_base (79)..(79): a, c, t, g, unknown or other
  modified_base (110)..(110): a, c, t, g, unknown or other
  modified_base (112)..(112): a, c, t, g, unknown or other
  modified_base (125)..(125): a, c, t, g, unknown or other
  modified_base (155)..(155): a, c, t, g, unknown or other
  modified_base (162)..(162): a, c, t, g, unknown or other
  modified_base (197)..(197): a, c, t, g, unknown or other
  modified_base (208)..(208): a, c, t, g, unknown or other
  modified_base (218)..(218): a, c, t, g, unknown or other
  modified_base (229)..(229): a, c, t, g, unknown or other
  modified_base (240)..(240): a, c, t, g, unknown or other
  modified_base (251)..(251): a, c, t, g, unknown or other
  modified_base (256)..(256): a, c, t, g, unknown or other
  modified_base (277)..(277): a, c, t, g, unknown or other
  modified_base (281)..(281): a, c, t, g, unknown or other
  modified_base (302)..(302): a, c, t, g, unknown or other
  modified_base (315)..(315): a, c, t, g, unknown or other
  modified_base (328)..(328): a, c, t, g, unknown or other
  modified_base (343)..(343): a, c, t, g, unknown or other
  modified_base (349)..(349): a, c, t, g, unknown or other
  modified_base (361)..(361): a, c, t, g, unknown or other
  modified_base (389)..(389): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  modified_base (474)..(474): a, c, t, g, unknown or other
  modified_base (487)..(487): a, c, t, g, unknown or other
  modified_base (496)..(496): a, c, t, g, unknown or other
  modified_base (518)..(518): a, c, t, g, unknown or other
  modified_base (533)..(533): a, c, t, g, unknown or other
  modified_base (542)..(542): a, c, t, g, unknown or other
  modified_base (552)..(552): a, c, t, g, unknown or other
  modified_base (601)..(601): a, c, t, g, unknown or other
  modified_base (608)..(608): a, c, t, g, unknown or other
  modified_base (619)..(619): a, c, t, g, unknown or other
  modified_base (625)..(625): a, c, t, g, unknown or other
  modified_base (633)..(633): a, c, t, g, unknown or other
  modified_base (638)..(638): a, c, t, g, unknown or other
  modified_base (641)..(641): a, c, t, g, unknown or other
  modified_base (643)..(643): a, c, t, g, unknown or other
  modified_base (655)..(655): a, c, t, g, unknown or other
  modified_base (682)..(682): a, c, t, g, unknown or other
  modified_base (698)..(698): a, c, t, g, unknown or other
  modified_base (752)..(752): a, c, t, g, unknown or other
  modified_base (759)..(759): a, c, t, g, unknown or other
  modified_base (785)..(785): a, c, t, g, unknown or other
aaagttctncttactagaaaaaaggattgtgaattcttcccacttctcacttatcatctgntaagcattttgcagatangacatctagatatgggaaaacataagaaaantntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactngaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcmttactttgtactctacagtgcttgtttanctcttanggggtttgttctattaaattacactncataataa

SEQ ID NO: 4156 - DNA, 642 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (138)..(138): a, c, t, g, unknown or other
  modified_base (219)..(219): a, c, t, g, unknown or other
  modified_base (296)..(296): a, c, t, g, unknown or other
  modified_base (300)..(300): a, c, t, g, unknown or other
  modified_base (314)..(314): a, c, t, g, unknown or other
  modified_base (463)..(463): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcatttncttgcaaatagcctaccctttctcttacacgtcctttgacacattttagatggtttngccatacaaaacntttcnattttnagttaaangtaggctnagnaaacatttcaagaaactgaagtgtttcttttttcacctgcttttaatctaaagtcttattatatctggattttaacatttnttaaaagtaatgtcagattataaatgtttggattttattcattttctaaatgattctgactggtttcctacatatanaatnatgaccygcaaaanaagatgtgycctttactttctaattatttgcaactaatctgtactggtttatacatctaggaaactgatgagcaactggtgggagtgtgtatctttttcatatgaagcatgcttctagtggtttactattagacaataatgggttggcntttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4157 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtaytagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4158 - DNA, 126 bp, Artificial Sequence
  Description of Artificial Sequence: Synthetic polynucleotide
  modified_base (50)..(50): a, c, t, g, unknown or other
  modified_base (112)..(112): a, c, t, g, unknown or other
tacccgcaaaagtttcaagaagtattaacaaaagaaaaaaatttttttyncccccaggaatkgggcrgggacagtgggtgctgggaaatcagtcccttgggacagggggccnggccaggatgctaa

SEQ ID NO: 4159 - DNA, 1141 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  modified_base (194)..(194): a, c, t, g, unknown or other
  modified_base (211)..(211): a, c, t, g, unknown or other
  modified_base (231)..(231): a, c, t, g, unknown or other
  modified_base (254)..(254): a, c, t, g, unknown or other
  modified_base (287)..(287): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (331)..(331): a, c, t, g, unknown or other
  modified_base (356)..(356): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
  modified_base (394)..(394): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (443)..(443): a, c, t, g, unknown or other
  modified_base (458)..(458): a, c, t, g, unknown or other
  modified_base (476)..(476): a, c, t, g, unknown or other
  modified_base (488)..(488): a, c, t, g, unknown or other
  modified_base (498)..(498): a, c, t, g, unknown or other
  modified_base (512)..(512): a, c, t, g, unknown or other
  modified_base (525)..(525): a, c, t, g, unknown or other
  modified_base (534)..(534): a, c, t, g, unknown or other
  modified_base (536)..(536): a, c, t, g, unknown or other
  modified_base (569)..(569): a, c, t, g, unknown or other
  modified_base (636)..(636): a, c, t, g, unknown or other
  modified_base (640)..(640): a, c, t, g, unknown or other
  modified_base (654)..(654): a, c, t, g, unknown or other
  modified_base (656)..(656): a, c, t, g, unknown or other
  modified_base (667)..(667): a, c, t, g, unknown or other
  modified_base (669)..(669): a, c, t, g, unknown or other
  modified_base (676)..(676): a, c, t, g, unknown or other
  modified_base (719)..(756): a, c, t, g, unknown or other
  modified_base (758)..(822): a, c, t, g, unknown or other
  modified_base (844)..(844): a, c, t, g, unknown or other
  modified_base (865)..(865): a, c, t, g, unknown or other
  modified_base (873)..(873): a, c, t, g, unknown or other
  modified_base (883)..(883): a, c, t, g, unknown or other
  modified_base (887)..(887): a, c, t, g, unknown or other
  modified_base (892)..(892): a, c, t, g, unknown or other
  modified_base (894)..(894): a, c, t, g, unknown or other
  modified_base (932)..(932): a, c, t, g, unknown or other
  modified_base (938)..(938): a, c, t, g, unknown or other
  modified_base (940)..(940): a, c, t, g, unknown or other
  modified_base (954)..(954): a, c, t, g, unknown or other
  modified_base (973)..(973): a, c, t, g, unknown or other
  modified_base (978)..(978): a, c, t, g, unknown or other
  modified_base (986)..(986): a, c, t, g, unknown or other
  modified_base (1000)..(1000): a, c, t, g, unknown or other
  modified_base (1010)..(1094): a, c, t, g, unknown or other
  modified_base (1096)..(1114): a, c, t, g, unknown or other
  modified_base (1135)..(1135): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttantattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcntccactaaccagaagcatgtcccagctctcttctgtgtcccaccattagaaaatcaaaagctgactntagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaanatacaccnttgatcatantgtntctcnancaaaagcttcaatggtcaagtactgaacmttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 4160 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacmataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4161 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatackttttcctaaattccncnaataaccatcctgctactgctttgtgtgaaattctccaaaaaaaattttacttttccaaaataagtcangctccctctcttaggatncaaaaccacaccatggtcccagccaatctttcagcctg

SEQ ID NO: 4162 - DNA, 611 bp, Artificial Sequence
  Description of Artificial Sequence: Synthetic polynucleotide
  modified_base (1)..(1): a, c, t, g, unknown or other
  modified_base (3)..(3): a, c, t, g, unknown or other
  modified_base (43)..(43): a, c, t, g, unknown or other
  misc_feature (75)..(75): May or may not be present
  modified_base (78)..(78): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (134)..(134): a, c, t, g, unknown or other
  modified_base (140)..(140): a, c, t, g, unknown or other
  modified_base (156)..(156): a, c, t, g, unknown or other
  modified_base (179)..(179): a, c, t, g, unknown or other
  modified_base (189)..(189): a, c, t, g, unknown or other
  modified_base (200)..(200): a, c, t, g, unknown or other
  modified_base (238)..(238): a, c, t, g, unknown or other
  modified_base (249)..(249): a, c, t, g, unknown or other
  modified_base (257)..(257): a, c, t, g, unknown or other
  modified_base (262)..(262): a, c, t, g, unknown or other
  modified_base (267)..(267): a, c, t, g, unknown or other
  modified_base (278)..(278): a, c, t, g, unknown or other
  modified_base (308)..(308): a, c, t, g, unknown or other
  modified_base (349)..(349): a, c, t, g, unknown or other
  modified_base (365)..(365): a, c, t, g, unknown or other
  modified_base (382)..(382): a, c, t, g, unknown or other
  modified_base (412)..(412): a, c, t, g, unknown or other
  modified_base (421)..(421): a, c, t, g, unknown or other
  modified_base (423)..(423): a, c, t, g, unknown or other
  modified_base (450)..(450): a, c, t, g, unknown or other
  modified_base (473)..(473): a, c, t, g, unknown or other
  modified_base (531)..(531): a, c, t, g, unknown or other
  modified_base (535)..(535): a, c, t, g, unknown or other
  modified_base (541)..(541): a, c, t, g, unknown or other
  modified_base (571)..(571): a, c, t, g, unknown or other
  modified_base (573)..(573): a, c, t, g, unknown or other
  modified_base (575)..(575): a, c, t, g, unknown or other
  modified_base (580)..(580): a, c, t, g, unknown or other
  modified_base (600)..(600): a, c, t, g, unknown or other
  modified_base (608)..(608): a, c, t, g, unknown or other
nanatttacttttaatctcatgagatgctgaggactaagaccncctccttcccagggcccaaagcaagaaaatgaggntgngangaggcccatctccanagatcttacccttggaataagggtctttttcccanacctcnttgacatctattcccnctgggctgtttttattttcctancccacactcntcagctttaangcactaaagaactttttggccacctcagracaaaaatntgttacaaaancacctccnaaatnraatnagctsagcctnactaagtaaatcaggctttggacaggctcngcttcctgttggttgttcatacatttgtgttgctcaagtcnatcttagaacccaacnccgccttgctggattcntgatggaatttctctttgcacctgaacaantcttcaggnancttctccttttaattttgaagaatgtnatacctttctgtcagaaaaggtntccaggtcttagattcacactcaagccatgaataatactcttctgggcatacataaanacangatttncccaaattctccttctcctagcacagagancncncttcnttccttccctttccctagcnttctttcnaat

SEQ ID NO: 4163 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (83)..(83): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (271)..(271): a, c, t, g, unknown or other
  modified_base (328)..(328): a, c, t, g, unknown or other
  modified_base (344)..(344): a, c, t, g, unknown or other
  modified_base (383)..(383): a, c, t, g, unknown or other
  modified_base (390)..(390): a, c, t, g, unknown or other
  modified_base (405)..(405): a, c, t, g, unknown or other
  modified_base (412)..(412): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
  modified_base (489)..(489): a, c, t, g, unknown or other
ctccactgtgtgcagtggaatcctgggaaatttaagagctactctctntangcngagactttgnaggcccattcagaganctnaataaaacaacatggttgcaggtaatggcaacaagytntagctnaaatcacccangacatttagatrtgtattccaggctgttagtttaatgtttgctgtatgtacnatgtagtcntttctgttaattatntttcttaactaatttttagaaagagtactctanttgangttcanaactgataggganaaaggtgggaatgggaatgggaaactgtacaaatatttaatgactctaaatatttgngagaactgaggaaatnwcacatggattatggtgctaaaaaggactgttatctaantgagttntttgtcctgatccanttcctgntccttatcttattgtactattccatcttctgccacttaaattcacagaaacaaaatgcaagnaaangntntcttncntgccttcccagactgatttaataaaaatggc

SEQ ID NO: 4164 - DNA, 1291 bp, Artificial Sequence
  Description of Artificial Sequence: Synthetic polynucleotide
  modified_base (173)..(173): a, c, t, g, unknown or other
  misc_feature (241)..(242): This region may encompass 'ag' or is absent in its entirety
  modified_base (272)..(272): a, c, t, g, unknown or other
  modified_base (283)..(283): a, c, t, g, unknown or other
  modified_base (441)..(441): a, c, t, g, unknown or other
  modified_base (624)..(624): a, c, t, g, unknown or other
  modified_base (834)..(834): a, c, t, g, unknown or other
  modified_base (863)..(863): a, c, t, g, unknown or other
  modified_base (1050)..(1050): a, c, t, g, unknown or other
  modified_base (1100)..(1100): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacaggggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4165 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcytgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4166 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (444)..(444): a, c, t, g, unknown or other
  modified_base (478)..(478): a, c, t, g, unknown or other
  modified_base (483)..(483): a, c, t, g, unknown or other
  modified_base (562)..(562): a, c, t, g, unknown or other
  modified_base (656)..(656): a, c, t, g, unknown or other
  modified_base (698)..(698): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggnctagccattaaagctgatgtctcttagttgcaancccancctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaagayangtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4167 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagargcagggggactttaggccataggtcttngcacaaggtttttccccagttcctacccctttcctttcctctctgtccagcaaacctgcttgtttctgtcacctgccttc

SEQ ID NO: 4168 - DNA, 617 bp, Artificial Sequence
  Description of Artificial Sequence: Synthetic polynucleotide
  modified_base (3)..(3): a, c, t, g, unknown or other
  modified_base (20)..(20): a, c, t, g, unknown or other
  modified_base (72)..(72): a, c, t, g, unknown or other
  modified_base (115)..(115): a, c, t, g, unknown or other
  modified_base (137)..(137): a, c, t, g, unknown or other
  modified_base (205)..(205): a, c, t, g, unknown or other
  misc_feature (247)..(247): May or may not be present
  modified_base (274)..(274): a, c, t, g, unknown or other
  modified_base (295)..(295): a, c, t, g, unknown or other
  modified_base (313)..(313): a, c, t, g, unknown or other
  modified_base (330)..(330): a, c, t, g, unknown or other
  modified_base (332)..(332): a, c, t, g, unknown or other
  modified_base (364)..(364): a, c, t, g, unknown or other
  modified_base (387)..(387): a, c, t, g, unknown or other
  modified_base (407)..(407): a, c, t, g, unknown or other
  modified_base (420)..(420): a, c, t, g, unknown or other
  modified_base (427)..(427): a, c, t, g, unknown or other
  modified_base (435)..(435): a, c, t, g, unknown or other
  modified_base (443)..(443): a, c, t, g, unknown or other
  modified_base (445)..(445): a, c, t, g, unknown or other
  modified_base (466)..(466): a, c, t, g, unknown or other
  modified_base (468)..(468): a, c, t, g, unknown or other
  modified_base (485)..(485): a, c, t, g, unknown or other
  modified_base (493)..(493): a, c, t, g, unknown or other
  modified_base (500)..(500): a, c, t, g, unknown or other
  modified_base (508)..(508): a, c, t, g, unknown or other
  modified_base (548)..(548): a, c, t, g, unknown or other
  modified_base (576)..(576): a, c, t, g, unknown or other
  modified_base (591)..(591): a, c, t, g, unknown or other
  modified_base (610)..(610): a, c, t, g, unknown or other
tcnaaacttttttgtttttnattaagcacattccacagtacaaagctgtcatgaataatayctgtacaattnaacagtttcaatagctgttcagacacaaatttatttcaaacanataattggcaaacataattaantacaagttagaattagactatcccagtgctttaaaacattaatatagcagtaatttacatttgctcanttatggttagcaaaataaagtccagagtatggctgggaatttactattataatcccagaaagtcagaantccttgggtgccaaagtcccntgctataatttagtaggnacaattcaaaggttgtntncatattcaaaggccatsatctcccaaggaacnaggggracttctatattaaacangcaaaaacaacaaaaaatcnattcattcattcngrattgnctcctccnctgccccntnccttccccctgggctttcctnancagtttgataytgaagntgtaggangaaaagnggtcaaanctaaatcactttcacaaccaccatcaagcttacaacatcnccttatgaatggaggtttattgtttacnctttgagactcaacntctcaaaaacataaattangtaacat

SEQ ID NO: 4169 - DNA, 162 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (27)..(27): a, c, t, g, unknown or other
  modified_base (67)..(67): a, c, t, g, unknown or other
  modified_base (96)..(96): a, c, t, g, unknown or other
  modified_base (99)..(99): a, c, t, g, unknown or other
  modified_base (125)..(125): a, c, t, g, unknown or other
  modified_base (130)..(130): a, c, t, g, unknown or other
anctacatcgtyatcntggcctgggcnacakactacctgttccagtccttccagaaggagctgcccngggcacactgcaaccacagctggaacacnccncmctgcatggaggacaccatgcgcangaacnagagtgtctggatcaccatcagctccaccaac

SEQ ID NO: 4170 - DNA, 423 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (38)..(38): a, c, t, g, unknown or other
  modified_base (42)..(42): a, c, t, g, unknown or other
  modified_base (53)..(53): a, c, t, g, unknown or other
  modified_base (72)..(72): a, c, t, g, unknown or other
  modified_base (87)..(87): a, c, t, g, unknown or other
  modified_base (91)..(91): a, c, t, g, unknown or other
  modified_base (101)..(101): a, c, t, g, unknown or other
  modified_base (111)..(111): a, c, t, g, unknown or other
  modified_base (157)..(157): a, c, t, g, unknown or other
  modified_base (159)..(159): a, c, t, g, unknown or other
  modified_base (168)..(168): a, c, t, g, unknown or other
  modified_base (184)..(184): a, c, t, g, unknown or other
  modified_base (196)..(196): a, c, t, g, unknown or other
  modified_base (229)..(229): a, c, t, g, unknown or other
  modified_base (232)..(232): a, c, t, g, unknown or other
  modified_base (234)..(234): a, c, t, g, unknown or other
  modified_base (237)..(237): a, c, t, g, unknown or other
  modified_base (241)..(241): a, c, t, g, unknown or other
  modified_base (272)..(272): a, c, t, g, unknown or other
  modified_base (275)..(275): a, c, t, g, unknown or other
  modified_base (291)..(291): a, c, t, g, unknown or other
  modified_base (296)..(296): a, c, t, g, unknown or other
  modified_base (299)..(299): a, c, t, g, unknown or other
  modified_base (313)..(313): a, c, t, g, unknown or other
  modified_base (322)..(322): a, c, t, g, unknown or other
  modified_base (347)..(347): a, c, t, g, unknown or other
  modified_base (358)..(358): a, c, t, g, unknown or other
  modified_base (409)..(409): a, c, t, g, unknown or other
ggtcnagcgatggngccttcctggccatttcttccacngacngttactgctcntttgtgacatttgagaaantgaacttggaattcntttnaaagagaagncagttttgancatgagaactcctgatacagcaaagaaaaccaagagtcagacacancnagggtcttngccaggacccagaccngtagagggaacnctgccagcagaacccaagaccccagcarccccngcncnacnccynctcaggccagacaggccccagccccaacagncancagggaccctccctcnatcantcntgctgtcaaaagcnccttgccgnggccttcggaggagaagaccctgcngcccagtagtnaaaacacaaaagcccayccatcccggagggtcactctgaacacactgcaancctggagcaagaca

SEQ ID NO: 4171 - DNA, 127 bp, Artificial Sequence
  Description of Artificial Sequence: Synthetic polynucleotide
  modified_base (3)..(3): a, c, t, g, unknown or other
  modified_base (40)..(40): a, c, t, g, unknown or other
  modified_base (93)..(93): a, c, t, g, unknown or other
  modified_base (113)..(113): a, c, t, g, unknown or other
canagtgcagtttaaaccaccatttctgtgaagctttctntgcctgttaccaggtactacccatacayacactacccacgaacaaagaaatgngcgttgttctgtgctgcacncaccattgtaacaa

SEQ ID NO: 4172 - DNA, 86 bp, Artificial Sequence
  Description of Artificial Sequence: Synthetic oligonucleotide
  modified_base (3)..(3): a, c, t, g, unknown or other
  modified_base (15)..(15): a, c, t, g, unknown or other
  modified_base (83)..(83): a, c, t, g, unknown or other
aancccaagtcgtcngagtcggagtcatactccaagtcgtcgacgaaggtctagwtctgtgggtagaagaaggagctttagcnttt

SEQ ID NO: 4173 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagycaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4174 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgygtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4175 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgsctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4176 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagytcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4177 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaaygccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4178 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (351)..(351): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagygtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4179 - DNA, 494 bp, Artificial Sequence
  Description of Artificial Sequence: Synthetic polynucleotide
  modified_base (29)..(29): a, c, t, g, unknown or other
  modified_base (54)..(54): a, c, t, g, unknown or other
  modified_base (84)..(84): a, c, t, g, unknown or other
  modified_base (117)..(117): a, c, t, g, unknown or other
  modified_base (124)..(124): a, c, t, g, unknown or other
  modified_base (126)..(126): a, c, t, g, unknown or other
  modified_base (131)..(131): a, c, t, g, unknown or other
  modified_base (135)..(135): a, c, t, g, unknown or other
  modified_base (137)..(137): a, c, t, g, unknown or other
  modified_base (145)..(145): a, c, t, g, unknown or other
  modified_base (155)..(155): a, c, t, g, unknown or other
  modified_base (166)..(166): a, c, t, g, unknown or other
  modified_base (202)..(202): a, c, t, g, unknown or other
  modified_base (244)..(244): a, c, t, g, unknown or other
  modified_base (247)..(247): a, c, t, g, unknown or other
  modified_base (251)..(251): a, c, t, g, unknown or other
  modified_base (259)..(259): a, c, t, g, unknown or other
  modified_base (283)..(283): a, c, t, g, unknown or other
  modified_base (290)..(290): a, c, t, g, unknown or other
  modified_base (297)..(297): a, c, t, g, unknown or other
  modified_base (315)..(315): a, c, t, g, unknown or other
  modified_base (332)..(332): a, c, t, g, unknown or other
  modified_base (346)..(346): a, c, t, g, unknown or other
  modified_base (354)..(354): a, c, t, g, unknown or other
  modified_base (362)..(362): a, c, t, g, unknown or other
  modified_base (364)..(364): a, c, t, g, unknown or other
  modified_base (391)..(391): a, c, t, g, unknown or other
  modified_base (419)..(419): a, c, t, g, unknown or other
  modified_base (432)..(432): a, c, t, g, unknown or other
  modified_base (459)..(459): a, c, t, g, unknown or other
  modified_base (465)..(465): a, c, t, g, unknown or other
  modified_base (480)..(480): a, c, t, g, unknown or other
  modified_base (483)..(483): a, c, t, g, unknown or other
  modified_base (493)..(493): a, c, t, g, unknown or other
taaaaattagcaaaaattgaagctaaagncaagtaatttcaaacttgacataanaatcatttggatactaataattcagctatntgcaaagsacttggtaggcactgcaagcagcanagatgtntntgagnaaangnagctgttnccaaagagcntatagttaagncartgaaatcagatagcattttatctcctagaaagnaaartgttaagtgtaggtgaaacttggacagtaggatccagnttnaatncaaatagnaacttctaaaatcagaaatgtatntagcacngaggatntgcctatttgaaaacagntgaagcaaatgaggagncaagcattctcttngggaaaantgtggacnanacaaatccagcaatgacatgattaccnggaccccaaaatgttctgaaaccctgcntaatgaccacctnaggcttatgactcctctagagtgaagnttgctntaatctttttctctnatntcttccttant

SEQ ID NO: 4180 - DNA, 350 bp, Artificial Sequence
  Description of Artificial Sequence: Synthetic polynucleotide
  modified_base (182)..(182): a, c, t, g, unknown or other
  modified_base (199)..(199): a, c, t, g, unknown or other
  modified_base (304)..(304): a, c, t, g, unknown or other
aatagttttttaaaaaaaacaaaatgtctctttcctctgctgaatgctgattgcaggcattamatctccagttgcttgatgaatgcatattcttttaaaaaacaagctatcataacctattttgagtatagcaatattaacaatatatttttatctcctttgtgatagatcagtgaagcaanttttgaaatgaagttantaattttgaatttaaatctacaatttaactttttaaaaatgctgaaattttatgtaacacttttcaaaggtctttagcataacaagttggtgagatgaamtggtnaaatgtgccaattagcttcctatcatagttcacttatatatcactt

SEQ ID NO: 4181 - DNA, 512 bp, Artificial Sequence
  Description of Artificial Sequence: Synthetic polynucleotide
  modified_base (103)..(103): a, c, t, g, unknown or other
  modified_base (153)..(153): a, c, t, g, unknown or other
  misc_feature (236)..(237): This region may encompass 'ca' or is absent in its entirety
aaacatcagagcayttaattctgacttggtgtaaggtgtatatcttatgtttgaacccactcttcctgtgggttttgttttaaaagaaatgactactattttntcttctcctgtagctatttctggaccctttgtggtttaagaaggaatacngggaggagaaagagaaaaaaaatgaaatcatccaggcaaggaagtttagaaagcagaggtttaggagaagaaaaagaagagacagtttctggyagcttcctgattttagaagctgattttgctacttttctttaattctgaggtagtttcaartattttgttgttacctttctggaaagaaataagtttatcrtttctacttttggatgtttttaggtgccagctaaaatacaaccctcatttattttccttgatgcagaaacctaacttctctaatttagcatacgagaagaccagtttgggaatatttaaagttcttcactttgggaaccttagatgttggtcgtccttagtaaaat

SEQ ID NO: 4182 - DNA, 325 bp, Artificial Sequence
  Description of Artificial Sequence: Synthetic polynucleotide
  modified_base (52)..(52): a, c, t, g, unknown or other
  modified_base (73)..(73): a, c, t, g, unknown or other
  modified_base (169)..(169): a, c, t, g, unknown or other
  modified_base (182)..(182): a, c, t, g, unknown or other
gagcagcatttcaaggccctccatgctttggtctctgccaaatcactattanatttttaagatttttttttanacattatacttacattacacaatgtcttaacactatgaagtaaaaatgtaaatattttaaactctggcttggaaatgaggaggcagaatctcaganattttcctaaaanaaataggagaggcaagctttctgagtccacaaaagtgccctctacctattgggtcaaagaaaaagtaatytctctatttgtaacaacatacataaattataaaccctgaagaaataggtccctaatagctataatctttaaca

SEQ ID NO: 4183 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatacnttttcctaaattccncnaataaccatcctgctactgctttgtgtgaaattctccaaaaaaaattttacttttccaaaataagtcargctccctctcttaggatncaaaaccacaccatggtcccagccaatctttcagcctg

SEQ ID NO: 4184 - DNA, 140 bp, Artificial Sequence
  Description of Artificial Sequence: Synthetic polynucleotide
  modified_base (9)..(9): a, c, t, g, unknown or other
  modified_base (22)..(22): a, c, t, g, unknown or other
  modified_base (45)..(45): a, c, t, g, unknown or other
  modified_base (50)..(50): a, c, t, g, unknown or other
  modified_base (79)..(79): a, c, t, g, unknown or other
  misc_feature (90)..(91): This region may encompass 'tt' or is absent in its entirety
  modified_base (121)..(121): a, c, t, g, unknown or other
  modified_base (134)..(134): a, c, t, g, unknown or other
tttaattanccagccctcattntgaaaaaagactagatgcagggnttaanaactagtgctttgattttacttgtaaaangtattttctttttttttcttgtgggcaccagtaaattaaacnctaataaaaatanaataca

SEQ ID NO: 4185 - DNA, 669 bp, Artificial Sequence
  Description of Artificial Sequence: Synthetic polynucleotide
  modified_base (51)..(51): a, c, t, g, unknown or other
  modified_base (112)..(112): a, c, t, g, unknown or other
  modified_base (116)..(162): a, c, t, g, unknown or other
  modified_base (170)..(170): a, c, t, g, unknown or other
  modified_base (223)..(223): a, c, t, g, unknown or other
  modified_base (435)..(435): a, c, t, g, unknown or other
  modified_base (477)..(477): a, c, t, g, unknown or other
  modified_base (537)..(537): a, c, t, g, unknown or other
  modified_base (629)..(658): a, c, t, g, unknown or other
aaaacagtaaatttttatgatagttttaaagttactaagattgagaatatntcaatttttcactgctcatgaatctgtgggttccttaaacaattatacataaggtctatanatannnnnnnnnnnnnnnnnnnnnnnnnnnnnnnnnnnnnnnnnnnnnnnaatggctnagaatcttgcctaacatattgtatgcactaagcaagtactagtaaaattattnatcaarttatcatcttcataccattcttcaaatggcatattgtttgttctaattaaaaactatgtttctgtcttatgttaagtagcaacaaaaattagaaggtctacttgttctgccctcttgagaaaatccaaagttaaatggtagttttactaatttcctttagattcagtaccttattttcctcacacaaaaatgtaaacattaagganaacatcatatttaaatgattcatcctacaatagacagacttngggtcattcattgattgggctgaagtctcactcactctctattatttctaattttttcangttaacagcctagaaaatctactacacatggaatgttataaattagaaattaacaccttggatgtacaaattataaaagtaaactgaaaagnnnnnnnnnnnnnnnnnnnnnnnnnnnnnnggattgttatt

SEQ ID NO: 4186 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtytctaaactttattttcaaaagcttaaggcccaaatacnaacttctctg

SEQ ID NO: 4187 - DNA, 100 bp, Artificial Sequence
  Description of Artificial Sequence: Synthetic polynucleotide
  modified_base (5)..(5): a, c, t, g, unknown or other
  modified_base (12)..(12): a, c, t, g, unknown or other
  modified_base (98)..(98): a, c, t, g, unknown or other
caagncaccacnaaaagtagtaaaatttttgttttactgagataagtggctacgttgttgtcatattgytagtgtaccgctaggttcatgtggaactnga

SEQ ID NO: 4188 - DNA, 109 bp, Artificial Sequence
  Description of Artificial Sequence: Synthetic polynucleotide
  misc_feature (34)..(34): May or may not be present
  modified_base (97)..(97): a, c, t, g, unknown or other
tatagacgttttaggaatttgaattttatacaactttttgctaatagatccctccattcttttcgagtaaagcccactatcttcatccgaaaaaaanaaagattttctc

SEQ ID NO: 4189 - DNA, 225 bp, Artificial Sequence
  Description of Artificial Sequence: Synthetic polynucleotide
  modified_base (2)..(2): a, c, t, g, unknown or other
  modified_base (13)..(13): a, c, t, g, unknown or other
  modified_base (38)..(38): a, c, t, g, unknown or other
  modified_base (40)..(40): a, c, t, g, unknown or other
  modified_base (51)..(51): a, c, t, g, unknown or other
  modified_base (57)..(57): a, c, t, g, unknown or other
  modified_base (78)..(78): a, c, t, g, unknown or other
  modified_base (109)..(109): a, c, t, g, unknown or other
  misc_feature (172)..(174): This region may encompass 'gag' or is absent in its entirety
  modified_base (182)..(182): a, c, t, g, unknown or other
  modified_base (200)..(200): a, c, t, g, unknown or other
  modified_base (219)..(219): a, c, t, g, unknown or other
gngggcctttgtnatgayttgcytgaaggtcratactncnttagaaaaaanttatcnaaaaatgaccacactgtgctntaatggtgccatgtctccatgtatctgccantctgcattctctgggcttgctgtagtgatgggagggattcaaatcctcctcttcagcaaaaggagaagtttcnatggatggtctgagacrngaagggatgtcctttcccngggctg

SEQ ID NO: 4190 - DNA, 1622 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  misc_feature (1441)..(1442): This region may encompass 'tc' or 'ct'
  modified_base (1515)..(1515): a, c, t, g, unknown or other
  modified_base (1525)..(1525): a, c, t, g, unknown or other
  modified_base (1534)..(1534): a, c, t, g, unknown or other
  modified_base (1568)..(1568): a, c, t, g, unknown or other
  modified_base (1587)..(1587): a, c, t, g, unknown or other
  modified_base (1593)..(1593): a, c, t, g, unknown or other
  modified_base (1619)..(1619): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctyyggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4191 - DNA, 1290 bp, Artificial Sequence
  Description of Artificial Sequence: Synthetic polynucleotide
  modified_base (173)..(173): a, c, t, g, unknown or other
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  modified_base (623)..(623): a, c, t, g, unknown or other
  modified_base (833)..(833): a, c, t, g, unknown or other
  modified_base (862)..(862): a, c, t, g, unknown or other
  modified_base (1049)..(1049): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctrctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4192 - DNA, 140 bp, Artificial Sequence
  Description of Artificial Sequence: Synthetic polynucleotide
  misc_feature (49)..(64): This region may encompass 'ccctctgcagcagtta' or is absent in its entirety
  modified_base (92)..(92): a, c, t, g, unknown or other
  modified_base (109)..(109): a, c, t, g, unknown or other
  modified_base (131)..(131): a, c, t, g, unknown or other
  modified_base (139)..(139): a, c, t, g, unknown or other
acctttttgaccacattatccagatcaactatcatgttgtgaagtttaccctctgcagcagttatatgaggcttggccccagcaacctcttntttctttgcattttcantcacacttttcatcttctctanctcttctnt

SEQ ID NO: 4193 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctaygttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4194 - DNA, 517 bp, Artificial Sequence
  Description of Artificial Sequence: Synthetic polynucleotide
  modified_base (83)..(83): a, c, t, g, unknown or other
  modified_base (226)..(226): a, c, t, g, unknown or other
  modified_base (266)..(266): a, c, t, g, unknown or other
  modified_base (315)..(315): a, c, t, g, unknown or other
  modified_base (344)..(344): a, c, t, g, unknown or other
  modified_base (404)..(404): a, c, t, g, unknown or other
  modified_base (408)..(408): a, c, t, g, unknown or other
  modified_base (414)..(414): a, c, t, g, unknown or other
  modified_base (426)..(426): a, c, t, g, unknown or other
  modified_base (461)..(461): a, c, t, g, unknown or other
  modified_base (483)..(483): a, c, t, g, unknown or other
  modified_base (490)..(490): a, c, t, g, unknown or other
tttttccaccaccccaatgctacctctataactcacacatgatagttttataaagataactacctggcattcaggttaaaatncaacwgcacccagaatagraaaaactataaattatgcattggactctgcratcaccagcccctacttgtaaatttcaatggagattcactttayttcaaaattagaaaactgatctcagagtttaaaacctcatttacagctncaaaatatttagaatctagaattatataacaaatacttantttcttagcatgcaaaaattatttacaaatcatttaaaaaggatgatcnacttaacagaaaaatgggcaatgacaaanagactattagttacctaaccaatagccactccccactcacaacctgttccttacagagtncacntcccantatcatggctgnaaggaacatcyttgctctctcaccctcacttgtanctaggacatggatggataccantcacggntgatgggatttaagaaaaaaatctgtt

SEQ ID NO: 4195 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaasaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4196 - DNA, 142 bp, Artificial Sequence
  Description of Artificial Sequence: Synthetic polynucleotide
  modified_base (3)..(3): a, c, t, g, unknown or other
  modified_base (9)..(9): a, c, t, g, unknown or other
  modified_base (31)..(31): a, c, t, g, unknown or other
  modified_base (41)..(41): a, c, t, g, unknown or other
  modified_base (43)..(43): a, c, t, g, unknown or other
  modified_base (51)..(51): a, c, t, g, unknown or other
  misc_feature (65)..(66): This region may encompass 'cc' or 'tt'
  modified_base (101)..(101): a, c, t, g, unknown or other
  modified_base (103)..(103): a, c, t, g, unknown or other
  modified_base (108)..(108): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
agngtccanagtatatataactcctgatcantgactagatntnacttaagnaaagaacacgttgyyagtaattcagatgtgccattgacacaggaggaccnangcctnagaaagacttttatctgagttacnagnttnagat

SEQ ID NO: 4197 - DNA, 120 bp, Artificial Sequence
  Description of Artificial Sequence: Synthetic polynucleotide
  modified_base (8)..(8): a, c, t, g, unknown or other
  modified_base (28)..(28): a, c, t, g, unknown or other
  modified_base (42)..(42): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (104)..(104): a, c, t, g, unknown or other
  modified_base (111)..(111): a, c, t, g, unknown or other
  modified_base (113)..(113): a, c, t, g, unknown or other
  modified_base (116)..(116): a, c, t, g, unknown or other
tttgtgcngcgaaatgacctgtttaccnacagcgccctctgnagcccagngcncngaacgggcyttttcatgatgttcctgcgttgtgtttacagcctccctgngaggggntngcncgca

SEQ ID NO: 4198 - DNA, 327 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (33)..(33): a, c, t, g, unknown or other
  modified_base (45)..(45): a, c, t, g, unknown or other
  modified_base (53)..(53): a, c, t, g, unknown or other
  modified_base (58)..(58): a, c, t, g, unknown or other
  modified_base (70)..(70): a, c, t, g, unknown or other
  modified_base (81)..(81): a, c, t, g, unknown or other
  modified_base (123)..(123): a, c, t, g, unknown or other
  modified_base (126)..(126): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (151)..(151): a, c, t, g, unknown or other
  modified_base (159)..(159): a, c, t, g, unknown or other
  modified_base (165)..(165): a, c, t, g, unknown or other
  modified_base (168)..(168): a, c, t, g, unknown or other
  modified_base (170)..(170): a, c, t, g, unknown or other
  modified_base (203)..(203): a, c, t, g, unknown or other
  modified_base (208)..(208): a, c, t, g, unknown or other
  modified_base (210)..(210): a, c, t, g, unknown or other
  modified_base (212)..(212): a, c, t, g, unknown or other
  modified_base (246)..(246): a, c, t, g, unknown or other
  modified_base (248)..(248): a, c, t, g, unknown or other
  modified_base (282)..(282): a, c, t, g, unknown or other
  modified_base (292)..(292): a, c, t, g, unknown or other
  modified_base (294)..(294): a, c, t, g, unknown or other
  modified_base (301)..(301): a, c, t, g, unknown or other
  modified_base (321)..(321): a, c, t, g, unknown or other
cactttggcattgtgatttaaaatgtnctncangatgggataatnatatgttnacaanggatataagganagtagacaggnatggtattcttacagccatgttcccaccagggtcaagagaanagnacaaagccnagncangccagggccnttccaaangggccncantncccctctggaggctgctgacctggagacctgcnatggncncntcttgccagctctccttcctctttctccagargncngcccagccttgctagctatatwttacacccaacngagcagagcnanactgganaataatcaaatgtttccccnttttaa

SEQ ID NO: 4199 - DNA, 288 bp, Artificial Sequence
  Description of Artificial Sequence: Synthetic polynucleotide
  modified_base (36)..(36): a, c, t, g, unknown or other
  modified_base (143)..(189): a, c, t, g, unknown or other
  modified_base (236)..(236): a, c, t, g, unknown or other
ctggaggatgcacacaacaaataaataatttagagngctctgaaatatggtcagacagcatatgccttgcagttatgtctacactttgtgcttgatccaagcatacatattattggggcaatatctgactgataccttttaannnnnnnnnnnnnnnnnnnnnnnnnnnnnnnnnnnnnnnnnnnnnnnatgttttatagaaaatatatctgggcctggctacatttccagagtgncccatttctcttggttcaaatttccrtctagaaatcaagttaaatctttggg

SEQ ID NO: 4200 - DNA, 1870 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  misc_feature (905)..(906): This region may encompass 'ct' or is absent in its entirety
  modified_base (940)..(940): a, c, t, g, unknown or other
  modified_base (949)..(949): a, c, t, g, unknown or other
  modified_base (1003)..(1003): a, c, t, g, unknown or other
  modified_base (1330)..(1330): a, c, t, g, unknown or other
  modified_base (1334)..(1334): a, c, t, g, unknown or other
  modified_base (1353)..(1353): a, c, t, g, unknown or other
  modified_base (1437)..(1437): a, c, t, g, unknown or other
  modified_base (1546)..(1546): a, c, t, g, unknown or other
  modified_base (1594)..(1594): a, c, t, g, unknown or other
  modified_base (1633)..(1633): a, c, t, g, unknown or other
  modified_base (1759)..(1759): a, c, t, g, unknown or other
  modified_base (1788)..(1788): a, c, t, g, unknown or other
  modified_base (1809)..(1809): a, c, t, g, unknown or other
  modified_base (1823)..(1823): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctctacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4201 - DNA, 350 bp, Artificial Sequence
  Description of Artificial Sequence: Synthetic polynucleotide
  modified_base (144)..(144): a, c, t, g, unknown or other
  modified_base (185)..(231): a, c, t, g, unknown or other
  modified_base (271)..(271): a, c, t, g, unknown or other
  modified_base (310)..(310): a, c, t, g, unknown or other
  modified_base (315)..(315): a, c, t, g, unknown or other
  modified_base (333)..(333): a, c, t, g, unknown or other
  modified_base (347)..(347): a, c, t, g, unknown or other
ccacactcatcatcgtcattactccyattactatgamgtgaagagttgtgctgctaggacrggagcagcaacttttcaacaccaatcrcttttttagayggcctcctttctagccttgttagttgcccaaattctgaaaaaaancaagaactaagactctagaaggagatccgagaggcagacrnnnnnnnnnnnnnnnnnnnnnnnnnnnnnnnnnnnnnnnnnnnnnnnagaygaaggaggaatcaggagtaatgccaagaatgagaanatctgtataagcagttcagaaaaggggcatcatgagtcnctctnctcagtgctgccccaagngttccacagtttgntcc

SEQ ID NO: 4202 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcytcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4203 - DNA, 337 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (21)..(21): a, c, t, g, unknown or other
  modified_base (39)..(39): a, c, t, g, unknown or other
  modified_base (44)..(44): a, c, t, g, unknown or other
  modified_base (58)..(58): a, c, t, g, unknown or other
  modified_base (88)..(88): a, c, t, g, unknown or other
  modified_base (99)..(99): a, c, t, g, unknown or other
  modified_base (117)..(117): a, c, t, g, unknown or other
  modified_base (191)..(191): a, c, t, g, unknown or other
  modified_base (216)..(216): a, c, t, g, unknown or other
  modified_base (230)..(230): a, c, t, g, unknown or other
  modified_base (235)..(235): a, c, t, g, unknown or other
  modified_base (263)..(263): a, c, t, g, unknown or other
  modified_base (302)..(302): a, c, t, g, unknown or other
ttctntctcatgcctntctgnctrtgtccacagtgtctnaattnaaggtccttggtcntcaaggaaccaagactacactgagatccantcttgggaagngcctctccttcaacctcnggtaccactcatccataaacaccaacactrtttgcctctttgtgtatcataaagtccctcattgaaacagcccnttaaactccagtctggaaaacaaanccactgggctacantaagnaccaattttagacacagacatcctcccncttcctcttgaccccaggtattctctgccaaactacaantcctccaggaaatcagcatctagcagcacccccac

SEQ ID NO: 4204 - DNA, 225 bp, Artificial Sequence
  Description of Artificial Sequence: Synthetic polynucleotide
  modified_base (83)..(122): a, c, t, g, unknown or other
  modified_base (124)..(124): a, c, t, g, unknown or other
  modified_base (131)..(131): a, c, t, g, unknown or other
  modified_base (135)..(135): a, c, t, g, unknown or other
ggccttccaagaagagatattttagttgcaataaatgagctctttctacatgaggctgagggtttggcttccttaattctgcnnnnnnnnnnnnnnnnnnnnnnnnnnnnnnnnnnnnnnnncncacccantganrttcaaagaggaagagcaaaagcctgaacttgccatatcaatgactaactayagagttattcattggaataagatacataggatttgcat

SEQ ID NO: 4205 - DNA, 190 bp, Artificial Sequence
  Description of Artificial Sequence: Synthetic polynucleotide
  modified_base (85)..(85): a, c, t, g, unknown or other
  modified_base (105)..(105): a, c, t, g, unknown or other
gcagtgtgccaggtgattgggatgtacgactacaccgcgcagaatgaygatgagctggccttcaacaagggccagatcatcaacntcctcaacaaggaggacccngactggtggaaaggagaagtcaatggacaagtggggctcttcccatccaattatgtgaagytgaccacagacatggacccaagcc

SEQ ID NO: 4206 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaakatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4207 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaasagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4208 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (444)..(444): a, c, t, g, unknown or other
  modified_base (478)..(478): a, c, t, g, unknown or other
  modified_base (483)..(483): a, c, t, g, unknown or other
  modified_base (562)..(562): a, c, t, g, unknown or other
  modified_base (656)..(656): a, c, t, g, unknown or other
  modified_base (696)..(696): a, c, t, g, unknown or other
  modified_base (698)..(698): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgytgttgtacagaaagtcaaatgtgcagggaagggtgtgtatatttcctgagtagccagagggcagccaggnctagccattaaagctgatgtctcttagttgcaancccancctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaaganangtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4209 - DNA, 175 bp, Artificial Sequence
  Description of Artificial Sequence: Synthetic polynucleotide
  modified_base (11)..(11): a, c, t, g, unknown or other
  modified_base (19)..(19): a, c, t, g, unknown or other
  modified_base (40)..(40): a, c, t, g, unknown or other
  modified_base (53)..(53): a, c, t, g, unknown or other
  modified_base (56)..(56): a, c, t, g, unknown or other
  modified_base (77)..(77): a, c, t, g, unknown or other
  modified_base (93)..(93): a, c, t, g, unknown or other
  modified_base (109)..(109): a, c, t, g, unknown or other
  misc_feature (119)..(120): This region may encompass 'ac' or 'gt'
  modified_base (167)..(167): a, c, t, g, unknown or other
agaactttcanagaggagnaattttcccacggtggtgaanggcagtgtgccanrcngagggctgcagggacagtagnatagaagggctaaacngtggtgagagtgttgnaacattctcrygtagctgacacataaactgtaaatgggatgtgagacaagaaaagcanaggctagg

SEQ ID NO: 4210 - DNA, 700 bp, Artificial Sequence
  Description of Artificial Sequence: Synthetic polynucleotide
  modified_base (59)..(59): a, c, t, g, unknown or other
  modified_base (70)..(70): a, c, t, g, unknown or other
  modified_base (99)..(99): a, c, t, g, unknown or other
  modified_base (133)..(133): a, c, t, g, unknown or other
  modified_base (167)..(167): a, c, t, g, unknown or other
  modified_base (268)..(268): a, c, t, g, unknown or other
  modified_base (304)..(304): a, c, t, g, unknown or other
  modified_base (381)..(381): a, c, t, g, unknown or other
  modified_base (408)..(408): a, c, t, g, unknown or other
  modified_base (456)..(456): a, c, t, g, unknown or other
  modified_base (485)..(485): a, c, t, g, unknown or other
  modified_base (521)..(521): a, c, t, g, unknown or other
  modified_base (582)..(582): a, c, t, g, unknown or other
  modified_base (630)..(630): a, c, t, g, unknown or other
  modified_base (664)..(664): a, c, t, g, unknown or other
  modified_base (696)..(696): a, c, t, g, unknown or other
tcatgtgtcagttctgttgggcagacttctgtggagaccytaccaggcrtcagcatgtngcacaagaganagtccctgctgggggcagttggtgactcnggagctggtgctccgaagccattagcgctgccangctccttgcagctcatggagtcctgcctgggtgnaggcagtcctggccgtgtgccagctttgctctgcattcaggtggttggagagtctcacattctcactcaggtgtgagacttcatagcacaagtctcagggnaacaggtagcaccctgtttcttaagagcacagtggnttaggtggacacaggcacaccacatgtgtggcagaggcgggcccagccatggcccctcctccctataccggtacaangtgaggaagctctggatggtcctcccngcaccccaggaccatagggtgaggggtctcctgggttgggccccattngcccctagcraggtcaggcctgccggccnctgtcacaaataataagagcagggcaagaggagggncaaaagagatgggtggaggtggaggccagggagggctccccagggcaggggtrgtttaggnaggcgaggggcaagcaggaagctcttggatcwtyccatacagtctccngattgtgaatccttccrgggttctgacctcccyngaaaaacagacaggacacacacccaggcctgnaggc

SEQ ID NO: 4211 - DNA, 150 bp, Artificial Sequence
  Description of Artificial Sequence: Synthetic polynucleotide
  modified_base (26)..(26): a, c, t, g, unknown or other
tgtgacaaattctatggcatctttcnctcctaatctttttttaaatgcttttgtttggtatttgataakaatgtgtctatggttacttttcaactgtgcaacacatttatctccatgccgagtcaaactttctaatgaagttaatagttt

SEQ ID NO: 4212 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcrgtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4213 - DNA, 435 bp, Artificial Sequence
  Description of Artificial Sequence: Synthetic polynucleotide
  modified_base (22)..(22): a, c, t, g, unknown or other
  modified_base (65)..(70): a, c, t, g, unknown or other
  modified_base (72)..(103): a, c, t, g, unknown or other
  modified_base (175)..(175): a, c, t, g, unknown or other
  modified_base (180)..(180): a, c, t, g, unknown or other
  modified_base (257)..(257): a, c, t, g, unknown or other
  modified_base (347)..(347): a, c, t, g, unknown or other
  modified_base (373)..(373): a, c, t, g, unknown or other
ttttaaaattatgcttaaaaanttttttattcaagctaraatttgaatatagmtaaatatcttcnnnnnnynnnnnnnnnnnnnnnnnnnnnnnnnnnnnnnnctaagagatttgcttgccaataggagcygcrtaagagtgtactcaagaagaaaataacattttcctgtatanaggtnaaaattaaaatgaaggggtgagagacagaccttgagaatacaaaatcatagtggacattgaactgaggaaagcacanagttcttggcaccaaaaaattaaaagatattgagatattataaaagtacaattcacatgttttatttaaatcagaaagaaaattrtgtgnttttgtataatttaattgattacaangaaataatttttagaaaattttatcaccaacttgttaaaaatagatggcacttccattgaaa

SEQ ID NO: 4214 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttkaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4215 - DNA, 744 bp, Artificial Sequence
  Description of Artificial Sequence: Synthetic polynucleotide
  modified_base (58)..(58): a, c, t, g, unknown or other
  modified_base (261)..(261): a, c, t, g, unknown or other
  modified_base (286)..(286): a, c, t, g, unknown or other
  modified_base (356)..(356): a, c, t, g, unknown or other
  modified_base (396)..(396): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacantcctcccacgacaaagttttaccytcagkaattgtgctcacaacagctttcctcctagagwtttctgccnagaacatacacaggtgcctagaagactcctggcttatctnaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 4216 - DNA, 167 bp, Artificial Sequence
  Description of Artificial Sequence: Synthetic polynucleotide
  modified_base (6)..(6): a, c, t, g, unknown or other
  modified_base (30)..(30): a, c, t, g, unknown or other
  modified_base (32)..(32): a, c, t, g, unknown or other
  modified_base (49)..(49): a, c, t, g, unknown or other
  modified_base (64)..(64): a, c, t, g, unknown or other
  modified_base (67)..(67): a, c, t, g, unknown or other
  modified_base (94)..(94): a, c, t, g, unknown or other
  modified_base (100)..(100): a, c, t, g, unknown or other
  modified_base (146)..(146): a, c, t, g, unknown or other
  modified_base (154)..(154): a, c, t, g, unknown or other
  modified_base (159)..(159): a, c, t, g, unknown or other
  modified_base (161)..(161): a, c, t, g, unknown or other
tttctnactcctggtatttctaaaaagcanancaaaatcaatttcacanccaagacatcttganatntcccaaacttgggcaaagttgacarcngaattntaaggagctgcttcccattaagaagaggatattaggaaagaaaatnatcagaantcttngnttaaac

SEQ ID NO: 4217 - DNA, 125 bp, Artificial Sequence
  Description of Artificial Sequence: Synthetic polynucleotide
  modified_base (15)..(15): a, c, t, g, unknown or other
  modified_base (17)..(17): a, c, t, g, unknown or other
  misc_feature (52)..(53): This region may encompass 'gg' or 'aa'
  modified_base (98)..(98): a, c, t, g, unknown or other
  modified_base (105)..(105): a, c, t, g, unknown or other
  modified_base (110)..(110): a, c, t, g, unknown or other
  modified_base (113)..(113): a, c, t, g, unknown or other
caaacaaaaattgtnantttttgtattgaaaggtcagtggtggtaagacaarrtrtcttgtaaattaagattttaagaagtgcattaaaatgttttanaattacntctgnganttctgtatatca

SEQ ID NO: 4218 - DNA, 272 bp, Artificial Sequence
  Description of Artificial Sequence: Synthetic polynucleotide
  modified_base (33)..(33): a, c, t, g, unknown or other
  modified_base (114)..(114): a, c, t, g, unknown or other
  modified_base (122)..(122): a, c, t, g, unknown or other
  modified_base (134)..(134): a, c, t, g, unknown or other
  modified_base (159)..(159): a, c, t, g, unknown or other
  modified_base (175)..(175): a, c, t, g, unknown or other
  modified_base (205)..(205): a, c, t, g, unknown or other
  modified_base (259)..(259): a, c, t, g, unknown or other
gggacacaagtgcaggttcagggcaaggtgtgngagcacactcagtccctggcctcggagtctctctggatggcttcttgcctagggtgactgacagagggakggatgatatgnaaaggcanctgttctcctcngacctaaccccaattcttactccangggttcatgacagccnattctgctggagactgtgtcttaaaacttnctcccctagtttctctcaagtacccctcgtgagctgtgatttcactgggctttnaactcttaggcca

SEQ ID NO: 4219 - DNA, 400 bp, Artificial Sequence
  Description of Artificial Sequence: Synthetic polynucleotide
  modified_base (268)..(268): a, c, t, g, unknown or other
  modified_base (358)..(358): a, c, t, g, unknown or other
acagtcaagaagcwgataggtgactgctattcccctctygctgaaaacgcagccacttggagtcagcttgatggcagtggtggctcaggccttgaacacgtgagaatagactatgttgtcaagatgctgatgaaccgcacttctgcctgacttgrtgcrttgtctcaggtctcagcactcamaatggatgctcataatcctacacacaatccccaaatgtcaatgaggatcattggccaaccatacctcagtgcatggggggtagtanggttatccattaaggccccaccttccacctcacaaatacttctgatcagagggatgagcttgggtaattttgggatgcatgacaggatgntgtcagcagactggccaaatccacattcagtatttcccatca

SEQ ID NO: 4220 - DNA, 941 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  misc_feature (846)..(847): This region may encompass 'ca' or 'tg'
  modified_base (908)..(908): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggyrtttctgcagatgaggtcttcatgctgtactttaatgcctccactgaaagccagagttrgtnggcttttctggcttcctcttcagcaactgcatg

SEQ ID NO: 4221 - DNA, 828 bp, Artificial Sequence
  Description of Artificial Sequence: Synthetic polynucleotide
  modified_base (4)..(4): a, c, t, g, unknown or other
  modified_base (13)..(13): a, c, t, g, unknown or other
  modified_base (18)..(18): a, c, t, g, unknown or other
  modified_base (21)..(21): a, c, t, g, unknown or other
  modified_base (53)..(53): a, c, t, g, unknown or other
  modified_base (67)..(67): a, c, t, g, unknown or other
  modified_base (69)..(69): a, c, t, g, unknown or other
  modified_base (86)..(86): a, c, t, g, unknown or other
  modified_base (95)..(95): a, c, t, g, unknown or other
  modified_base (117)..(117): a, c, t, g, unknown or other
  modified_base (120)..(120): a, c, t, g, unknown or other
  modified_base (130)..(130): a, c, t, g, unknown or other
  modified_base (144)..(144): a, c, t, g, unknown or other
  modified_base (184)..(184): a, c, t, g, unknown or other
  modified_base (211)..(211): a, c, t, g, unknown or other
  modified_base (223)..(223): a, c, t, g, unknown or other
  modified_base (228)..(228): a, c, t, g, unknown or other
  modified_base (231)..(231): a, c, t, g, unknown or other
  modified_base (257)..(257): a, c, t, g, unknown or other
  modified_base (279)..(279): a, c, t, g, unknown or other
  modified_base (284)..(284): a, c, t, g, unknown or other
  modified_base (292)..(292): a, c, t, g, unknown or other
  modified_base (313)..(313): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (338)..(338): a, c, t, g, unknown or other
  modified_base (372)..(493): a, c, t, g, unknown or other
  modified_base (499)..(499): a, c, t, g, unknown or other
  modified_base (521)..(521): a, c, t, g, unknown or other
  modified_base (549)..(549): a, c, t, g, unknown or other
  modified_base (557)..(557): a, c, t, g, unknown or other
  modified_base (565)..(565): a, c, t, g, unknown or other
  modified_base (569)..(591): a, c, t, g, unknown or other
  modified_base (593)..(593): a, c, t, g, unknown or other
  modified_base (610)..(610): a, c, t, g, unknown or other
  modified_base (650)..(650): a, c, t, g, unknown or other
  modified_base (686)..(686): a, c, t, g, unknown or other
  modified_base (720)..(720): a, c, t, g, unknown or other
  modified_base (746)..(746): a, c, t, g, unknown or other
  modified_base (764)..(764): a, c, t, g, unknown or other
  modified_base (786)..(786): a, c, t, g, unknown or other
  modified_base (788)..(788): a, c, t, g, unknown or other
  modified_base (803)..(803): a, c, t, g, unknown or other
  modified_base (805)..(805): a, c, t, g, unknown or other
  modified_base (821)..(821): a, c, t, g, unknown or other
tatncatgtgtantgcanacnttctttcttcctttctcatccttgcagtcgcnttctcttccttttncntctttcattccrtttangtgtcaaanaccacargtctgggaaaggaanaanatgtaagagnaagatgcctactangtgggcacatagagagctcctggtgggacagggactgcanagaagagccactgcttggagagrtttntcaaaaactctnccttnatntaaatgaatttcaacagcaaagtgangacatatccacacatttaaatnaaatncttccccntttccctggcakttaatatangaaatantntancatgtttatcaanggaaaacaccaccaaagacctgctttttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatngtcataattggtcctgtctaanatgagagccatggggaatgcccaattanattggytngtttcctnccannnnnnnnnnnnnnnnnnnnnnntntcctgatgaggtggttntccagatacttgtatctggtatccagattttctctgcttntccacagcaagaaatgatgtagggcatctctaggcngtcttttgcccctaatccagactcatgggtctcngggattaagggtcctccaccaattcntaagaccttcacctattntccttgttaccatcatcacaananttctgtttctgattncncctgctcctctcccanattttta

SEQ ID NO: 4222 - DNA, 612 bp, Artificial Sequence
  Description of Artificial Sequence: Synthetic polynucleotide
  modified_base (88)..(88): a, c, t, g, unknown or other
  modified_base (104)..(104): a, c, t, g, unknown or other
  modified_base (173)..(173): a, c, t, g, unknown or other
  modified_base (176)..(176): a, c, t, g, unknown or other
  modified_base (184)..(184): a, c, t, g, unknown or other
  modified_base (215)..(215): a, c, t, g, unknown or other
  modified_base (402)..(402): a, c, t, g, unknown or other
  modified_base (488)..(488): a, c, t, g, unknown or other
  modified_base (512)..(512): a, c, t, g, unknown or other
  modified_base (556)..(556): a, c, t, g, unknown or other
tatctcctccacacaggtgcagattttgcttttagttttacaaagattagagcaaraaagaagctgcttttaaaacaagaaaaaaaancactttcagtgcaccntctcgtataatattatatcctattgtaccctgccrtggtttaggcatcactgtattctctcattgtgtnatntatatatnaagagctaaataaatgtctgtttcattgaangtaagarctaaataaatgtctgtttcattgaatagttcagctctgctttcacctcttctaattaaaccaacaccacatgccacttgctacctcctgaacaattactacttttgtgtttcttcatttatccaacaaacagctccaaagatggaacattcaactctaacataaaccctgctgcttccangggctctgcrcccayccccttgttatgctacactgacatttagacctactagaaggtaactgkttttcatttatgtgtccttacangtcccaataagagtccctgaaganaaaaggtacattgcatacccaacatcaattacatttatcttccntcatatgcaaagcatcgtatgtttccacattcaagaagcaaactcatgagtcatca

SEQ ID NO: 4223 - DNA, 77 bp, Artificial Sequence
  Description of Artificial Sequence: Synthetic oligonucleotide
caacagggagctggatccatccatcaccagggaatctttactayggaacactctcctacctatgaagaaagaggtag

SEQ ID NO: 4224 - DNA, 115 bp, Artificial Sequence
  Description of Artificial Sequence: Synthetic polynucleotide
  modified_base (5)..(5): a, c, t, g, unknown or other
  modified_base (99)..(99): a, c, t, g, unknown or other
  modified_base (107)..(107): a, c, t, g, unknown or other
tacangaactttttttaaactagcaggggttaygtgaatagtgggattacagayattttcttcattatgctggtccatatttaaatcctctccccctcncaaaaaanggtaaaaa

SEQ ID NO: 4225 - DNA, 523 bp, Artificial Sequence
  Description of Artificial Sequence: Synthetic polynucleotide
  modified_base (26)..(26): a, c, t, g, unknown or other
  modified_base (63)..(63): a, c, t, g, unknown or other
  modified_base (174)..(174): a, c, t, g, unknown or other
  modified_base (245)..(285): a, c, t, g, unknown or other
  modified_base (337)..(337): a, c, t, g, unknown or other
  modified_base (399)..(399): a, c, t, g, unknown or other
  modified_base (408)..(408): a, c, t, g, unknown or other
  misc_feature (440)..(441): This region may encompass 'tg' or 'ca'
  modified_base (490)..(490): a, c, t, g, unknown or other
  modified_base (494)..(494): a, c, t, g, unknown or other
agtagatacattttayatagaatttngttaagtattccttaaaatatcactttaatatgccanaagaataaccacagaatagtgttactttaaagtaaaaagatayaaatagragcccaaaatgttaagtggggttttacaatcaagaagacacaccagaataagatatttttnaaataccatgtacrttaaagagatcatacttccttaccctaataaayagccatgtagtacaagttttaacnnnnnnnnnnnnnnnnnnnnnnnnnnnnnnnnnnnnnnnnncaacttctatttggttttayctgagccattcctttatactgacagttacatnatgtgatttcagttatatatgtagttwttggtaatttttcaaaaatagaatataatgaaaancttcatttnaatcattactgaactgcacctacattaatcayratatacctatgaaaagatgtataacatatactagtatgccaaaaaaaanaagnkacaaaacagtatttatagtataattcca

SEQ ID NO: 4226 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (478)..(478): a, c, t, g, unknown or other
  modified_base (483)..(483): a, c, t, g, unknown or other
  modified_base (562)..(562): a, c, t, g, unknown or other
  modified_base (656)..(656): a, c, t, g, unknown or other
  modified_base (696)..(696): a, c, t, g, unknown or other
  modified_base (698)..(698): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggrctagccattaaagctgatgtctcttagttgcaancccancctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaaganangtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4227 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctartagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4228 - DNA, 463 bp, Artificial Sequence
  Description of Artificial Sequence: Synthetic polynucleotide
  modified_base (158)..(158): a, c, t, g, unknown or other
  modified_base (245)..(245): a, c, t, g, unknown or other
  modified_base (308)..(308): a, c, t, g, unknown or other
  modified_base (337)..(337): a, c, t, g, unknown or other
  modified_base (385)..(385): a, c, t, g, unknown or other
  modified_base (425)..(425): a, c, t, g, unknown or other
  modified_base (446)..(446): a, c, t, g, unknown or other
tcagacyctgactcacgctaccgcccctgccacccccagttgtttcagaagtgctgcctggggcagaggatcctggaggcctgggaagccaaygaccacacacagtaagagccactcggacayggagggacccagcctggccagtcagggatgcaganacgcacctcagccgggcactggtgatgctgcgtgcaggactgcatgctctggtggagcgctgggtgtgcgacacagctccacactcnaggctgccatgcraggggccctcctactgggtggacagctgcaaatgctacttggggaggggncacagggagctgacrggaagcagtcccanccccaccaggcacctgctctggcccctgcccagcctggcttgcctagnctttgccctcttgcgggtcccctgtccattcctgatcttnccccaagaactcgggtgctcnatcagcactcrcacatg

SEQ ID NO: 4229 - DNA, 214 bp, Artificial Sequence
  Description of Artificial Sequence: Synthetic polynucleotide
  modified_base (18)..(18): a, c, t, g, unknown or other
  modified_base (48)..(48): a, c, t, g, unknown or other
  modified_base (149)..(149): a, c, t, g, unknown or other
gaaacatctaagaccaanttgatctaggttgaaactagttgggcttcnctgaacttgcacttctgcagtttactgactggagggrgttttattatttactggcttgcattgggcaaattatctaacgaggatctgcaccacctttcttnatcttcctggaaacaagagactagctgagatatgtttgtctcatggtagtgaaagaggcacaaat

SEQ ID NO: 4230 - DNA, 1277 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  misc_feature (651)..(652): This region may encompass 'ca' or 'ag'
  modified_base (732)..(732): a, c, t, g, unknown or other
  modified_base (748)..(748): a, c, t, g, unknown or other
  modified_base (756)..(756): a, c, t, g, unknown or other
  modified_base (836)..(836): a, c, t, g, unknown or other
  modified_base (860)..(860): a, c, t, g, unknown or other
  modified_base (902)..(902): a, c, t, g, unknown or other
  modified_base (936)..(936): a, c, t, g, unknown or other
  modified_base (1052)..(1052): a, c, t, g, unknown or other
  modified_base (1069)..(1069): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatamratgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4231 - DNA, 299 bp, Artificial Sequence
  Description of Artificial Sequence: Synthetic polynucleotide
  modified_base (23)..(23): a, c, t, g, unknown or other
  modified_base (44)..(44): a, c, t, g, unknown or other
  modified_base (48)..(48): a, c, t, g, unknown or other
  modified_base (56)..(56): a, c, t, g, unknown or other
  modified_base (81)..(81): a, c, t, g, unknown or other
  modified_base (95)..(95): a, c, t, g, unknown or other
  modified_base (104)..(104): a, c, t, g, unknown or other
  modified_base (106)..(106): a, c, t, g, unknown or other
  modified_base (110)..(110): a, c, t, g, unknown or other
  modified_base (123)..(123): a, c, t, g, unknown or other
  modified_base (139)..(139): a, c, t, g, unknown or other
  modified_base (145)..(145): a, c, t, g, unknown or other
  modified_base (159)..(159): a, c, t, g, unknown or other
  modified_base (174)..(174): a, c, t, g, unknown or other
  modified_base (193)..(193): a, c, t, g, unknown or other
  modified_base (223)..(223): a, c, t, g, unknown or other
  modified_base (233)..(233): a, c, t, g, unknown or other
  modified_base (244)..(244): a, c, t, g, unknown or other
  modified_base (246)..(246): a, c, t, g, unknown or other
  misc_feature (257)..(258): This region may encompass 'tg' or 'ca'
  modified_base (285)..(285): a, c, t, g, unknown or other
tcttatgcaaagtacragaagangtcacattgctttctttcctnatcnttttgagnaggtgtttttacaaagacctcctgntctgaacactgctnttctgcctntnatgngcccagcttcctngatggaccacacatgntaccangcatggcttatganacccttgagcctggnttatgaygacccttggtgntcattttcctcatcattttcagcctgggcnagcttgtctnctcttggacanangaaggtgcctyrttaacctctttttaccctctcccatanccagtgcacaaaaa

SEQ ID NO: 4232 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagygtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4233 - DNA, 117 bp, Artificial Sequence
  Description of Artificial Sequence: Synthetic polynucleotide
  modified_base (61)..(61): a, c, t, g, unknown or other
ttctaaagtgtgaaaacttctcgtctatactgagwgtatatracaaattatatacacgcangctgtgmaaatatgcttatattcacatactgcagataaaacacaactctccatggt

SEQ ID NO: 4234 - DNA, 667 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (60)..(60): a, c, t, g, unknown or other
  modified_base (85)..(85): a, c, t, g, unknown or other
  modified_base (110)..(110): a, c, t, g, unknown or other
  modified_base (124)..(124): a, c, t, g, unknown or other
  modified_base (133)..(133): a, c, t, g, unknown or other
  modified_base (157)..(157): a, c, t, g, unknown or other
  modified_base (185)..(185): a, c, t, g, unknown or other
  modified_base (204)..(204): a, c, t, g, unknown or other
  modified_base (209)..(209): a, c, t, g, unknown or other
  modified_base (219)..(219): a, c, t, g, unknown or other
  misc_feature (261)..(261): May or may not be present
  modified_base (270)..(270): a, c, t, g, unknown or other
  modified_base (297)..(297): a, c, t, g, unknown or other
  modified_base (315)..(315): a, c, t, g, unknown or other
  modified_base (320)..(320): a, c, t, g, unknown or other
  modified_base (324)..(324): a, c, t, g, unknown or other
  modified_base (355)..(355): a, c, t, g, unknown or other
  modified_base (383)..(383): a, c, t, g, unknown or other
  modified_base (395)..(395): a, c, t, g, unknown or other
  modified_base (411)..(411): a, c, t, g, unknown or other
  modified_base (432)..(432): a, c, t, g, unknown or other
  modified_base (452)..(452): a, c, t, g, unknown or other
  modified_base (470)..(470): a, c, t, g, unknown or other
  modified_base (475)..(475): a, c, t, g, unknown or other
  modified_base (487)..(487): a, c, t, g, unknown or other
  modified_base (517)..(517): a, c, t, g, unknown or other
  modified_base (532)..(532): a, c, t, g, unknown or other
  modified_base (546)..(546): a, c, t, g, unknown or other
  modified_base (578)..(578): a, c, t, g, unknown or other
  modified_base (613)..(613): a, c, t, g, unknown or other
  modified_base (653)..(653): a, c, t, g, unknown or other
  modified_base (656)..(656): a, c, t, g, unknown or other
cccctcagcatggncctctgaaccagcctgacctgncctgcaggctccaacacaccagcnggccctgccagaaccttggcaaggncrggatgcatgaattccagagccangacagcccgtcaanagggccttnttatttccccttcccagggccacnactgcacagaataatgatttttgacagngaagccaaatgaatactangggangtgaccactngtactcaggagtacttatgagaaaaagaataagaacaaaaaatgtttaagntacctctctattgtataatatatactnacaacaaataaaacattntgttnaacnttagaaattacattttaaaacaagattctcnttaaaaacacacacaaaccacacacacnaatgacaacaanaataaaaacactgtangaatactgcaggaagggttcnaggtaatccacatcaacccnggtatcaggttcttgagnccagnccatggctaagngcgaacacactctgtattagtgtctcaagncagggggccctgacnccagcaactttgangttaaactgttatgtacattatatctacatgngaatacagtattttaaattaggaggcaagcacacntataaaggtgttactctaccaaatatcaggagatggttgnggncagagaacagt

SEQ ID NO: 4235 - DNA, 258 bp, Artificial Sequence
  Description of Artificial Sequence: Synthetic polynucleotide
  modified_base (200)..(200): a, c, t, g, unknown or other
  modified_base (225)..(225): a, c, t, g, unknown or other
  modified_base (249)..(249): a, c, t, g, unknown or other
tatgttaaaatcastayaatacctatgaataagaacaatttaggtattcaagcaataaattcagaattttytttcttcttctctggctaaaaacatactcaaaagtaagagcaacataacgctttctcctaaccttttctgtcttgaccckttatccaattactcttcttccacatttctcccatgaaaggcctctcctnttgaccctctatccaattactcttnttccacatttttcccatgaaaggnctctcctct

SEQ ID NO: 4236 - DNA, 174 bp, Artificial Sequence
  Description of Artificial Sequence: Synthetic polynucleotide
  modified_base (5)..(5): a, c, t, g, unknown or other
  modified_base (17)..(17): a, c, t, g, unknown or other
  modified_base (65)..(65): a, c, t, g, unknown or other
  modified_base (113)..(113): a, c, t, g, unknown or other
  modified_base (131)..(131): a, c, t, g, unknown or other
  modified_base (150)..(150): a, c, t, g, unknown or other
acatnatattatatttntttgcataatgaagagccatgtctgccactttgccacctgttactacnacatttgcaccagtatcagcaatagctttgacttrtgcatccatgagnttttcttctcccttactnaahttcatcaattcttcancagtctttatcaacactgttccct

SEQ ID NO: 4237 - DNA, 263 bp, Artificial Sequence
  Description of Artificial Sequence: Synthetic polynucleotide
  modified_base (10)..(10): a, c, t, g, unknown or other
  modified_base (95)..(95): a, c, t, g, unknown or other
  modified_base (251)..(251): a, c, t, g, unknown or other
cttctcacangccctaaatgtagagcaatctctctgccagtggtcactaggatcacagccctgaggaagctgagggtaacctggtgaatcttctncagtcacattcgggacaggaaccttagyggggttccctgaggagaacagtctcaggaatcctaacctcagccaagacagaggctgggccagatcaatgtcagatagaacctcacaagttttatgtctgacccttctccaccaacaataaagcatgncaatcagtatca

SEQ ID NO: 4238 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcarctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4239 - DNA, 120 bp, Artificial Sequence
  Description of Artificial Sequence: Synthetic polynucleotide
  modified_base (16)..(16): a, c, t, g, unknown or other
  misc_feature (73)..(74): This region may encompass 'gt' or 'ta'
ttcacaattcttaacnctattctatgtggaatacaaaatgcctttttatctgaattaacatgcatttraaaakwtttagtatatgtgaaaataaaggaattataaatcagtaggaaagat

SEQ ID NO: 4240 - DNA, 254 bp, Artificial Sequence
  Description of Artificial Sequence: Synthetic polynucleotide
  modified_base (16)..(16): a, c, t, g, unknown or other
  modified_base (37)..(37): a, c, t, g, unknown or other
  modified_base (45)..(45): a, c, t, g, unknown or other
  modified_base (101)..(101): a, c, t, g, unknown or other
  modified_base (104)..(104): a, c, t, g, unknown or other
  modified_base (148)..(148): a, c, t, g, unknown or other
gcggtggccgcccggntcccggaagtcgctcggaggnggcacgcnctggcaggtggggctgcagctgcgagagggggcgggcctgggaaccaccgsgggtntgngggccttgccattctcargattcctgcggaaacgctgtgcgctngctgcgctccaggagcaggagcaggaggaggtcgccctctagagtctggagtctggggagaggaggaaggctccttctttgtaggccactggtgttgctgaaacct

SEQ ID NO: 4241 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (239)..(239): a, c, t, g, unknown or other
  modified_base (241)..(241): a, c, t, g, unknown or other
  modified_base (279)..(279): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (359)..(359): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccanccccttcngttctgtggcattgncacaatnaggaatctacttttgtgcttttacacattgaactgacaggtnanrtcaggcatcgactgtcacaggggccagtggagaggtngnagggacgcccacattcgatgaatcctgcatcayggtgttggacttcttgttnttngacactaaacttgttcacattynataacttgagcacgaataaaggcagctcayagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4242 - DNA, 127 bp, Artificial Sequence
  Description of Artificial Sequence: Synthetic polynucleotide
  modified_base (5)..(5): a, c, t, g, unknown or other
  modified_base (8)..(8): a, c, t, g, unknown or other
  modified_base (26)..(26): a, c, t, g, unknown or other
  modified_base (39)..(39): a, c, t, g, unknown or other
  modified_base (80)..(80): a, c, t, g, unknown or other
  modified_base (86)..(86): a, c, t, g, unknown or other
  modified_base (91)..(91): a, c, t, g, unknown or other
  modified_base (96)..(96): a, c, t, g, unknown or other
cttanttnaatctgaagcttgcccancattttctcacgncaccttaatttgcaaaagtggagcttgggtraaatgaggantgaaanaagangaaanagaaggaggtcatattgagtgtaaaaaatgt

SEQ ID NO: 4243 - DNA, 325 bp, Artificial Sequence
  Description of Artificial Sequence: Synthetic polynucleotide
  modified_base (13)..(13): a, c, t, g, unknown or other
  modified_base (132)..(132): a, c, t, g, unknown or other
  modified_base (149)..(149): a, c, t, g, unknown or other
  modified_base (309)..(309): a, c, t, g, unknown or other
  modified_base (322)..(322): a, c, t, g, unknown or other
ttgcaggcattanatctccagttgcttgatgaatgcatattcttttaaaaaacaagctatcataacctattttgagtatagcaatattaacaatatatttttatctcctttgtgatagatcagtgaagcaanttttgaaatgaagttantaattttgaatttaaatctacaatttaactttttaaaaatgctgaaattttatgtaacacttttcaaaggtctttagcataacaagttggtgagatgaamtggtraaatgtgccaattagcttcctatcatagttcacttatatatcacttgcattttantaagtatcgttanaga

SEQ ID NO: 4244 - DNA, 619 bp, Artificial Sequence
  Description of Artificial Sequence: Synthetic polynucleotide
  modified_base (201)..(201): a, c, t, g, unknown or other
  modified_base (204)..(204): a, c, t, g, unknown or other
  modified_base (222)..(222): a, c, t, g, unknown or other
  modified_base (259)..(259): a, c, t, g, unknown or other
  modified_base (389)..(389): a, c, t, g, unknown or other
  modified_base (551)..(551): a, c, t, g, unknown or other
  modified_base (556)..(556): a, c, t, g, unknown or other
atagagtgattttgaagattaagcaggctagtgggtcaagcacgtagtacaacatttgaagcccaaaggcagggagtgtgagccccaggtggtggtggsggggatgaaaggagaagcagraggcaatggggaasgagrcacttgaractggaactcagggctcttcagagagagaagcttycaggtcctggagaaggggynagncccatgcgagtcccctgnaygctcaaaaggaagggccaggtttccctgacacagngggctcygtggtctcctcccctcctwttcacctcrggagggagggaaagaggggaagagaaggtcctgcagaggaggyaggatggccggttgaggggggccttgggcgctttttcccaagggctgcctcntgyggcwgccccaggggcttccttgaacaagaaytccctgctctcccgctgagagccagggtgggtcctctrtccctcaccatgaagttcaatgagtattggagagtccgcatgaggygaaggggcttcagcccaaccrctggtccctgctgcactcactcntcaanaaggaccaccagctgcctgatggtgagcatggagcaggtctgagtggaccagactagggccaa

SEQ ID NO: 4245 - DNA, 263 bp, Artificial Sequence
  Description of Artificial Sequence: Synthetic polynucleotide
  modified_base (38)..(38): a, c, t, g, unknown or other
attcagggtgaggaatacattggctgtatgtgattttnatgtgtgctttagggatttgccccatagctgctcctgaatgtggggtcttagaaaacatctttacccttcaaagcatattctgctgattggctaaattgcagcaggaaaaaatatcagcagctctgtctttatgtcacttgccttcaaagcaaaagrtttttcaggcacagtaatttgatttagtctgtgttaaaaatcataaatagcctagaaatamaaaaaaa

SEQ ID NO: 4246 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgyggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4247 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (131)..(131): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcnttctttanttcaccccttatagctanttantaaatctcacaaatcctatccttctnatctctctgaaatgtatgtaccctttccnttctattctcaccacccatgtttctttgtttccttctagcctgtgtaataatctcataatckyayctcctgtacctgccttctttctagtccagaatacnttttcctaaattccncnaataaccatcctgctactgctttgtgtgaaattctccaaaaaaaattttacttttccaaaataagtcangctccctctcttaggatncaaaaccacaccatggtcccagccaatctttcagcctg

SEQ ID NO: 4248 - DNA, 98 bp, Artificial Sequence
  Description of Artificial Sequence: Synthetic oligonucleotide
  modified_base (6)..(6): a, c, t, g, unknown or other
  modified_base (13)..(13): a, c, t, g, unknown or other
  modified_base (50)..(50): a, c, t, g, unknown or other
  modified_base (52)..(52): a, c, t, g, unknown or other
  modified_base (55)..(55): a, c, t, g, unknown or other
  modified_base (74)..(74): a, c, t, g, unknown or other
  modified_base (78)..(78): a, c, t, g, unknown or other
  modified_base (84)..(84): a, c, t, g, unknown or other
  modified_base (95)..(95): a, c, t, g, unknown or other
gtaagntttattntacctttttctcaacatgacaccaacacartcaaaangnagntagtgaggtgctaacatgngarnattaanccagtgattcnggt

SEQ ID NO: 4249 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacmaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4250 - DNA, 225 bp, Artificial Sequence
  Description of Artificial Sequence: Synthetic polynucleotide
  modified_base (41)..(41): a, c, t, g, unknown or other
  modified_base (94)..(94): a, c, t, g, unknown or other
  modified_base (111)..(111): a, c, t, g, unknown or other
  modified_base (171)..(171): a, c, t, g, unknown or other
agaatcttggctcattcactgaattctttgggaagggctgnttccctttgcrcatcttcactaaacttggacctttttgatgactctcattttntatcaccaccatagtcnttagatgtccagtggagcagggaaactgatggtttyctgcacaggttgctyggggcaaanatggaagttggaagtaaggaaaagcatggagttggaattgkatgctgaatgctg

SEQ ID NO: 4251 - DNA, 135 bp, Artificial Sequence
  Description of Artificial Sequence: Synthetic polynucleotide
  modified_base (27)..(27): a, c, t, g, unknown or other
  modified_base (112)..(112): a, c, t, g, unknown or other
  modified_base (115)..(115): a, c, t, g, unknown or other
  modified_base (117)..(117): a, c, t, g, unknown or other
  modified_base (123)..(123): a, c, t, g, unknown or other
ggtgtagtcccggaccgtggtgcctcngagggacgccacattctcgataagtagtmvcttgccccgcagggagcccaggctcacaggctccccgccggccagcgggcgcgcncgnanaaggcntacaccgactgg

SEQ ID NO: 4252 - DNA, 1049 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  misc_feature (684)..(685): This region may encompass 'ta' or is absent in its entirety
  modified_base (712)..(712): a, c, t, g, unknown or other
  modified_base (726)..(726): a, c, t, g, unknown or other
  modified_base (753)..(753): a, c, t, g, unknown or other
  modified_base (789)..(789): a, c, t, g, unknown or other
  modified_base (992)..(992): a, c, t, g, unknown or other
  modified_base (995)..(995): a, c, t, g, unknown or other
  modified_base (1006)..(1006): a, c, t, g, unknown or other
  modified_base (1024)..(1024): a, c, t, g, unknown or other
  modified_base (1030)..(1030): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcatagttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4253 - DNA, 1941 bp, Artificial Sequence
  Description of Artificial Sequence: Synthetic polynucleotide
  modified_base (11)..(11): a, c, t, g, unknown or other
  misc_feature (113)..(113): May or may not be present
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtgggggcaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4254 - DNA, 271 bp, Artificial Sequence
  Description of Artificial Sequence: Synthetic polynucleotide
  modified_base (4)..(4): a, c, t, g, unknown or other
  modified_base (21)..(21): a, c, t, g, unknown or other
  modified_base (25)..(25): a, c, t, g, unknown or other
  modified_base (30)..(30): a, c, t, g, unknown or other
  modified_base (34)..(34): a, c, t, g, unknown or other
  modified_base (42)..(42): a, c, t, g, unknown or other
  modified_base (47)..(47): a, c, t, g, unknown or other
  modified_base (74)..(74): a, c, t, g, unknown or other
  modified_base (76)..(76): a, c, t, g, unknown or other
  modified_base (91)..(91): a, c, t, g, unknown or other
  modified_base (100)..(100): a, c, t, g, unknown or other
  modified_base (110)..(110): a, c, t, g, unknown or other
  modified_base (152)..(152): a, c, t, g, unknown or other
  modified_base (177)..(177): a, c, t, g, unknown or other
  modified_base (187)..(187): a, c, t, g, unknown or other
  modified_base (201)..(201): a, c, t, g, unknown or other
  modified_base (214)..(214): a, c, t, g, unknown or other
  modified_base (218)..(218): a, c, t, g, unknown or other
  modified_base (266)..(266): a, c, t, g, unknown or other
aaanaggtatataccagcctnctcnggaanctgntggtggancttangactggaaactgttgaaagttaaaaananttcccaaaccttgancatctactngacaaatttnatgtgtaccagggacaaatgaaagtatccttccaaaataygncccaaattattgtcaagcctttctntaataaaggnccattcctcaagcngctgtcacataangtgnaggtgatcaacagcaaatccattagcaacacaggataaagaaatttgnrtagc

SEQ ID NO: 4255 - DNA, 612 bp, Artificial Sequence
  Description of Artificial Sequence: Synthetic polynucleotide
  modified_base (88)..(88): a, c, t, g, unknown or other
  modified_base (104)..(104): a, c, t, g, unknown or other
  modified_base (173)..(173): a, c, t, g, unknown or other
  modified_base (176)..(176): a, c, t, g, unknown or other
  modified_base (184)..(184): a, c, t, g, unknown or other
  modified_base (215)..(215): a, c, t, g, unknown or other
  modified_base (402)..(402): a, c, t, g, unknown or other
  modified_base (417)..(417): a, c, t, g, unknown or other
  modified_base (488)..(488): a, c, t, g, unknown or other
  modified_base (512)..(512): a, c, t, g, unknown or other
tatctcctccacacaggtgcagattttgcttttagttttacaaagattagagcaaraaagaagctgcttttaaaacaagaaaaaaaancactttcagtgcaccntctcgtataatattatatcctattgtaccctgccrtggtttaggcatcactgtattctctcattgtgtnatntatatatnaagagctaaataaatgtctgtttcattgaangtaagarctaaataaatgtctgtttcattgaatagttcagctctgctttcacctcttctaattaaaccaacaccacatgccacttgctacctcctgaacaattactacttttgtgtttcttcatttatccaacaaacagctccaaagatggaacattcaactctaacataaaccctgctgcttccangggctctgcrcccanccccttgttatgctacactgacatttagacctactagaaggtaactgkttttcatttatgtgtccttacangtcccaataagagtccctgaaganaaaaggtacattgcatacccaacatcaattacatttatcttccytcatatgcaaagcatcgtatgtttccacattcaagaagcaaactcatgagtcatca

SEQ ID NO: 4256 - DNA, 498 bp, Artificial Sequence
  Description of Artificial Sequence: Synthetic polynucleotide
  modified_base (82)..(82): a, c, t, g, unknown or other
  modified_base (125)..(125): a, c, t, g, unknown or other
  modified_base (265)..(308): a, c, t, g, unknown or other
  modified_base (374)..(374): a, c, t, g, unknown or other
  modified_base (403)..(403): a, c, t, g, unknown or other
  modified_base (454)..(454): a, c, t, g, unknown or other
tttttgcctctaaatcttccaggtactgttgtttttgacaatgtaatrgatattacttctttctgtgccttcaaaatttcantaaggaaataaactggttaccaaaaacacctgtttgttaaaanttggagtcaaactttttaaagaagagatgtactttgttttctttcctaaatatttaaaaattaataggatttatccatagtataacatggttttaaaaagtaatttaactttagttttattgaatacctatttgtgtagnnnnnnnnnnnnnnnnnnnnnnnnnnnnnnnnnnnnnnnnnnnnggtataaattgtgcattttatatgatatttataccattattttactttgggttctctcatttaaanttataaccaaagttacactgttattcatnttttgtgctatgcatttaatattttcatggattccttttttttctattttnagctagtatatattgcattatatttaaaaccaccacaacaggta

SEQ ID NO: 4257 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatamagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4258 - DNA, 671 bp, Artificial Sequence
  Description of Artificial Sequence: Synthetic polynucleotide
  modified_base (29)..(29): a, c, t, g, unknown or other
  modified_base (44)..(44): a, c, t, g, unknown or other
  modified_base (61)..(61): a, c, t, g, unknown or other
  modified_base (78)..(78): a, c, t, g, unknown or other
  modified_base (84)..(84): a, c, t, g, unknown or other
  modified_base (88)..(88): a, c, t, g, unknown or other
  modified_base (216)..(216): a, c, t, g, unknown or other
  modified_base (226)..(226): a, c, t, g, unknown or other
  modified_base (229)..(229): a, c, t, g, unknown or other
  modified_base (234)..(234): a, c, t, g, unknown or other
  modified_base (258)..(258): a, c, t, g, unknown or other
  modified_base (300)..(300): a, c, t, g, unknown or other
  modified_base (363)..(430): a, c, t, g, unknown or other
  modified_base (481)..(481): a, c, t, g, unknown or other
  modified_base (503)..(503): a, c, t, g, unknown or other
  modified_base (559)..(559): a, c, t, g, unknown or other
  modified_base (639)..(639): a, c, t, g, unknown or other
  modified_base (646)..(646): a, c, t, g, unknown or other
  modified_base (657)..(657): a, c, t, g, unknown or other
  modified_base (670)..(670): a, c, t, g, unknown or other
ttgctttttcaatggggacataatcacanagatgcagatgtgtngtgcaaagaacacacangcaccagataaaataancataantgcncyttctacagacagaacacctggctttgtggaaagttagaaggccacacaatgcctcagaaaatgcataaaataaactaaarctaagcactaaattcaatactaaaaccccttcatctgggactcaangttaccattncgnttagnatgcaactataawaacatatgccnaaactttccaaaaacccacaatcttgaaagaaagtggtcccntgacatgcaggtatctgagttagcagttctgcttcaatgaagagaaagcaaaaaggaaaaggnnnnnnnnnnnnnnnnnnnnnnnnnnnnnnnnnnnnnnnnnnnnnnnnnnnnnnnnnnnnnnnnnnnncctccctttaaacatgaaggaacaaatgrcaaggtaagaacaaataatatnataggtttcaataaacaatatntttattcataattattacctgtctctggcattccctatccaccagtctagaaaaanatgtgacaaaaatgaaacaaaagaataaaatacatttttttctaacttgctgatagaagsttgatcattggaactctaantgcatgnaaaagtcttcnatctaatttaaana

SEQ ID NO: 4259 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (870)..(870): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacytttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacnaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4260 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggraagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4261 - DNA, 669 bp, Artificial Sequence
  Description of Artificial Sequence: Synthetic polynucleotide
  modified_base (51)..(51): a, c, t, g, unknown or other
  modified_base (112)..(112): a, c, t, g, unknown or other
  modified_base (116)..(162): a, c, t, g, unknown or other
  modified_base (170)..(170): a, c, t, g, unknown or other
  modified_base (223)..(223): a, c, t, g, unknown or other
  modified_base (229)..(229): a, c, t, g, unknown or other
  modified_base (435)..(435): a, c, t, g, unknown or other
  modified_base (477)..(477): a, c, t, g, unknown or other
  modified_base (629)..(658): a, c, t, g, unknown or other
aaaacagtaaatttttatgatagttttaaagttactaagattgagaatatntcaatttttcactgctcatgaatctgtgggttccttaaacaattatacataaggtctatanatannnnnnnnnnnnnnnnnnnnnnnnnnnnnnnnnnnnnnnnnnnnnnnaatggctnagaatcttgcctaacatattgtatgcactaagcaagtactagtaaaattattnatcaanttatcatcttcataccattcttcaaatggcatattgtttgttctaattaaaaactatgtttctgtcttatgttaagtagcaacaaaaattagaaggtctacttgttctgccctcttgagaaaatccaaagttaaatggtagttttactaatttcctttagattcagtaccttattttcctcacacaaaaatgtaaacattaagganaacatcatatttaaatgattcatcctacaatagacagacttngggtcattcattgattgggctgaagtctcactcactctctattatttctaattttttcaygttaacagcctagaaaatctactacacatggaatgttataaattagaaattaacaccttggatgtacaaattataaaagtaaactgaaaagnnnnnnnnnnnnnnnnnnnnnnnnnnnnnnggattgttatt

SEQ ID NO: 4262 - DNA, 816 bp, Artificial Sequence
  Description of Artificial Sequence: Synthetic polynucleotide
  modified_base (67)..(162): a, c, t, g, unknown or other
  modified_base (205)..(205): a, c, t, g, unknown or other
  modified_base (236)..(236): a, c, t, g, unknown or other
  modified_base (240)..(240): a, c, t, g, unknown or other
  modified_base (259)..(259): a, c, t, g, unknown or other
  modified_base (288)..(288): a, c, t, g, unknown or other
  modified_base (294)..(294): a, c, t, g, unknown or other
  modified_base (298)..(298): a, c, t, g, unknown or other
  modified_base (304)..(304): a, c, t, g, unknown or other
  modified_base (322)..(322): a, c, t, g, unknown or other
  modified_base (335)..(335): a, c, t, g, unknown or other
  modified_base (355)..(355): a, c, t, g, unknown or other
  modified_base (366)..(366): a, c, t, g, unknown or other
  modified_base (372)..(372): a, c, t, g, unknown or other
  modified_base (386)..(386): a, c, t, g, unknown or other
  modified_base (451)..(451): a, c, t, g, unknown or other
  modified_base (477)..(477): a, c, t, g, unknown or other
  modified_base (489)..(489): a, c, t, g, unknown or other
  modified_base (499)..(499): a, c, t, g, unknown or other
  modified_base (504)..(504): a, c, t, g, unknown or other
  modified_base (509)..(509): a, c, t, g, unknown or other
  modified_base (521)..(521): a, c, t, g, unknown or other
  modified_base (531)..(531): a, c, t, g, unknown or other
  modified_base (578)..(578): a, c, t, g, unknown or other
  modified_base (614)..(614): a, c, t, g, unknown or other
  modified_base (733)..(733): a, c, t, g, unknown or other
  modified_base (739)..(739): a, c, t, g, unknown or other
  modified_base (759)..(759): a, c, t, g, unknown or other
gtccactccctgagctgmgaataaatggaaagcttacacaggaattgaagaatttgaaaacgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaatgtataacattatacagagaggacagtggtaaactnaggactgctgccctttctatatgatgtaatnttanataagacaaacctataacngtctaatggaccactgtttacagtttgancaccantgcnttaccnatatttccttttaactanatctcataaattnatatgaaaaacccttatagncctattccacntaaggngaaggaaaactagnaagcatgaaaaatgaatattaatttaattaaacttttctataatggctcactgtctgttccagantctgaaaastcccaggtaccagaaanctggaaaaaaantagagccagnaaatnggacnaagaaggactcngcttycatantaaaatactcaacatccttgctgtttttaataatgtggaaagttganaatggtggtggtatkgctggtgggtttgtgtgtasntgcatgtggtgtatataattrtatacatataattacttttagagctcttgcatcttgaaaaacrcccatctgtttggtaacattttatgttgtggcactttcctcacatttgaaaatgngaattntgatacaaagacrtgtattntttttttccacactaagattcagaatgttctggcacagatatttctcattcatgtta

SEQ ID NO: 4263 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccyaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4264 - DNA, 213 bp, Artificial Sequence
  Description of Artificial Sequence: Synthetic polynucleotide
  modified_base (52)..(52): a, c, t, g, unknown or other
  modified_base (60)..(60): a, c, t, g, unknown or other
  modified_base (120)..(120): a, c, t, g, unknown or other
  modified_base (199)..(213): a, c, t, g, unknown or other
ttagcagttgaaaacaaattctacatattatctatgaccrtgcacatatgtngtataatntttaagcatgcataggaataatataaaaaaccagtttagacaattgtttacctctaaacnatgaaaagacacaaagccaaatgcttcagaatcacagttttaccaaaatgatcataaagaaatgattacttctcccatnnnnnnnnnnnnnnn

SEQ ID NO: 4265 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatrttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4266 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttraagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4267 - DNA, 246 bp, Artificial Sequence
  Description of Artificial Sequence: Synthetic polynucleotide
  modified_base (9)..(9): a, c, t, g, unknown or other
  modified_base (20)..(20): a, c, t, g, unknown or other
  modified_base (26)..(26): a, c, t, g, unknown or other
  modified_base (36)..(36): a, c, t, g, unknown or other
  modified_base (40)..(40): a, c, t, g, unknown or other
  modified_base (47)..(47): a, c, t, g, unknown or other
  modified_base (61)..(61): a, c, t, g, unknown or other
  modified_base (65)..(65): a, c, t, g, unknown or other
  modified_base (68)..(68): a, c, t, g, unknown or other
  modified_base (74)..(74): a, c, t, g, unknown or other
  modified_base (76)..(76): a, c, t, g, unknown or other
  modified_base (114)..(114): a, c, t, g, unknown or other
  modified_base (118)..(118): a, c, t, g, unknown or other
  modified_base (123)..(123): a, c, t, g, unknown or other
  modified_base (147)..(147): a, c, t, g, unknown or other
  modified_base (150)..(150): a, c, t, g, unknown or other
  modified_base (156)..(156): a, c, t, g, unknown or other
  modified_base (164)..(164): a, c, t, g, unknown or other
  modified_base (166)..(166): a, c, t, g, unknown or other
  modified_base (173)..(173): a, c, t, g, unknown or other
  modified_base (187)..(187): a, c, t, g, unknown or other
  modified_base (192)..(192): a, c, t, g, unknown or other
  modified_base (201)..(201): a, c, t, g, unknown or other
  modified_base (222)..(222): a, c, t, g, unknown or other
  modified_base (227)..(227): a, c, t, g, unknown or other
  modified_base (238)..(238): a, c, t, g, unknown or other
aagctctanaaatctactanaaagtnctgcaaaaantagnagatgangaggactctgakgnaganagnratcanangagatgagtgagcaggaagaggagcttgaggatgrccntacnatagncaaagactatcaagacctggaaanagnagtgcngtcttttngnatgacgntgtcctgaagacangcctngatattggnagaaacaaagtggaagatgcnttctncaaaggtgaantcaggctg

SEQ ID NO: 4268 - DNA, 167 bp, Artificial Sequence
  Description of Artificial Sequence: Synthetic polynucleotide
  modified_base (6)..(6): a, c, t, g, unknown or other
  modified_base (30)..(30): a, c, t, g, unknown or other
  modified_base (32)..(32): a, c, t, g, unknown or other
  modified_base (49)..(49): a, c, t, g, unknown or other
  modified_base (64)..(64): a, c, t, g, unknown or other
  modified_base (67)..(67): a, c, t, g, unknown or other
  modified_base (92)..(92): a, c, t, g, unknown or other
  modified_base (94)..(94): a, c, t, g, unknown or other
  modified_base (146)..(146): a, c, t, g, unknown or other
  modified_base (154)..(154): a, c, t, g, unknown or other
  modified_base (159)..(159): a, c, t, g, unknown or other
  modified_base (161)..(161): a, c, t, g, unknown or other
tttctnactcctggtatttctaaaaagcanancaaaatcaatttcacanccaagacatcttganatntcccaaacttgggcaaagttgacancngaattstaaggagctgcttcccattaagaagaggatattaggaaagaaaatnatcagaantcttngnttaaac

SEQ ID NO: 4269 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgrggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4270 - DNA, 944 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  misc_feature (317)..(318): This region may encompass 'at' or is absent in its entirety
  modified_base (341)..(341): a, c, t, g, unknown or other
  modified_base (376)..(376): a, c, t, g, unknown or other
  modified_base (404)..(404): a, c, t, g, unknown or other
  modified_base (412)..(412): a, c, t, g, unknown or other
  modified_base (467)..(467): a, c, t, g, unknown or other
  modified_base (492)..(492): a, c, t, g, unknown or other
  modified_base (507)..(507): a, c, t, g, unknown or other
  modified_base (513)..(513): a, c, t, g, unknown or other
  modified_base (525)..(525): a, c, t, g, unknown or other
  modified_base (614)..(614): a, c, t, g, unknown or other
  modified_base (711)..(711): a, c, t, g, unknown or other
  modified_base (759)..(759): a, c, t, g, unknown or other
  modified_base (839)..(839): a, c, t, g, unknown or other
  modified_base (877)..(877): a, c, t, g, unknown or other
  modified_base (883)..(883): a, c, t, g, unknown or other
  modified_base (904)..(904): a, c, t, g, unknown or other
  modified_base (913)..(913): a, c, t, g, unknown or other
  modified_base (917)..(917): a, c, t, g, unknown or other
  modified_base (931)..(931): a, c, t, g, unknown or other
  modified_base (933)..(933): a, c, t, g, unknown or other
  modified_base (937)..(937): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacatgttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4271 - DNA, 1949 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  misc_feature (743)..(746): This region may encompass 'ctaa' or is absent in its entirety
  modified_base (1031)..(1031): a, c, t, g, unknown or other
  modified_base (1279)..(1279): a, c, t, g, unknown or other
  modified_base (1347)..(1347): a, c, t, g, unknown or other
  modified_base (1352)..(1352): a, c, t, g, unknown or other
  modified_base (1356)..(1356): a, c, t, g, unknown or other
  modified_base (1412)..(1470): a, c, t, g, unknown or other
  modified_base (1595)..(1595): a, c, t, g, unknown or other
  modified_base (1732)..(1732): a, c, t, g, unknown or other
  modified_base (1825)..(1825): a, c, t, g, unknown or other
  modified_base (1910)..(1910): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaactaagtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4272 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagastgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4273 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctytgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4274 - DNA, 153 bp, Artificial Sequence
  Description of Artificial Sequence: Synthetic polynucleotide
  modified_base (2)..(2): a, c, t, g, unknown or other
tngctatgatgcatttgccaattgaaaggggcrgaagaaggcatctaaaaatcttgaaagtcgaactatctattcaacattttggacctgcagtgctaaaaaatgaactcacattagattgaaggaaagcatagggagatgtgaatgatatga

SEQ ID NO: 4275 - DNA, 175 bp, Artificial Sequence
  Description of Artificial Sequence: Synthetic polynucleotide
  modified_base (37)..(37): a, c, t, g, unknown or other
  modified_base (49)..(49): a, c, t, g, unknown or other
  modified_base (85)..(85): a, c, t, g, unknown or other
accagggaagagcaggttgcaggaagcacagggccanccccagagcagntgggggtagagatgagaggttggtttactgccaggntctggggttgcctcaccatcttcatgtttcctccagggaccctctcttatttcatgrtgctgtgtctagctctacatctctaaaatacca

SEQ ID NO: 4276 - DNA, 175 bp, Artificial Sequence
  Description of Artificial Sequence: Synthetic polynucleotide
  modified_base (37)..(37): a, c, t, g, unknown or other
  modified_base (81)..(81): a, c, t, g, unknown or other
  modified_base (119)..(119): a, c, t, g, unknown or other
  modified_base (140)..(140): a, c, t, g, unknown or other
gataagcaccatttgrctgatctaagccatcttattngccatgaagcgccatacytgttccagaagtatgttaaagagtcncatggacgggatgtacgtgtcattgtcgtgggaggccntgtggttggcaccatgttacnttgttcaacagatgggagaatgcaaagcaactgct

SEQ ID NO: 4277 - DNA, 246 bp, Artificial Sequence
  Description of Artificial Sequence: Synthetic polynucleotide
  modified_base (95)..(95): a, c, t, g, unknown or other
  modified_base (125)..(125): a, c, t, g, unknown or other
  modified_base (186)..(186): a, c, t, g, unknown or other
  modified_base (193)..(193): a, c, t, g, unknown or other
  misc_feature (207)..(207): May or may not be present
  modified_base (245)..(245): a, c, t, g, unknown or other
acatacattagatctgagtaagaatgcatcacttagggggaagggaagcagatgcttatctattttgtcttatctactgataactaaattcaganattgtaataaaagtaatacaaatgttatanttttctcttaatttttaaagagcaacgattayagtctgaaaaactgtcattcagcgactantgccatnctgaggccaaatctttttggttttcaatatccagctttatcatgtcacaatna

SEQ ID NO: 4278 - DNA, 99 bp, Artificial Sequence
  Description of Artificial Sequence: Synthetic oligonucleotide
  misc_feature (27)..(28): This region may encompass 'cg' or 'tc'
  modified_base (39)..(39): a, c, t, g, unknown or other
  modified_base (78)..(78): a, c, t, g, unknown or other
  modified_base (82)..(82): a, c, t, g, unknown or other
  modified_base (89)..(89): a, c, t, g, unknown or other
gaggtccttgccttatcaccaccattysttcaaaacagngaccctgtgtccttttagctcctctttttgtcagaggcncmtnccagatnacaccactct

SEQ ID NO: 4279 - DNA, 500 bp, Artificial Sequence
  Description of Artificial Sequence: Synthetic polynucleotide
  modified_base (181)..(181): a, c, t, g, unknown or other
  modified_base (195)..(195): a, c, t, g, unknown or other
  modified_base (280)..(280): a, c, t, g, unknown or other
  modified_base (315)..(315): a, c, t, g, unknown or other
  modified_base (318)..(318): a, c, t, g, unknown or other
cagcatcagcatctctccacaagccttcccagagaaaagggctgctcagaccatcccgctgttagtgagctactgtctggtcatgtgctgggtggacctcatcatctcatcttcttcaaccctgctgtggacgtgtaacccagtcttcctgagtatgcagaaccttgtgggcgatgtctangccactgttgttcnactggaacaaatcagctctgataaaaatatagttgacattctccaaaatatgcaaagtgctataaagctttaacaagttggcganggaaaacatttctaaaaaatagtcttctcctatanttnaattgttcaagtagccctggagttctttttatcttatttaataaaatgcatggaatcatacttttattatatttatatgctttcaaaactgatgcttctaaggaccatgtaatttctttaattcyagtgtctaccatgggttgacatttctgtatcaagtttcttacatttttattttcatt

SEQ ID NO: 4280 - DNA, 793 bp, Artificial Sequence
  Description of Artificial Sequence: Synthetic polynucleotide
  modified_base (9)..(9): a, c, t, g, unknown or other
  modified_base (61)..(61): a, c, t, g, unknown or other
  modified_base (79)..(79): a, c, t, g, unknown or other
  modified_base (112)..(112): a, c, t, g, unknown or other
  modified_base (125)..(125): a, c, t, g, unknown or other
  modified_base (155)..(155): a, c, t, g, unknown or other
  modified_base (162)..(162): a, c, t, g, unknown or other
  modified_base (197)..(197): a, c, t, g, unknown or other
  modified_base (208)..(208): a, c, t, g, unknown or other
  modified_base (218)..(218): a, c, t, g, unknown or other
  modified_base (229)..(229): a, c, t, g, unknown or other
  modified_base (240)..(240): a, c, t, g, unknown or other
  modified_base (251)..(251): a, c, t, g, unknown or other
  modified_base (256)..(256): a, c, t, g, unknown or other
  modified_base (277)..(277): a, c, t, g, unknown or other
  modified_base (281)..(281): a, c, t, g, unknown or other
  modified_base (302)..(302): a, c, t, g, unknown or other
  modified_base (315)..(315): a, c, t, g, unknown or other
  modified_base (328)..(328): a, c, t, g, unknown or other
  modified_base (343)..(343): a, c, t, g, unknown or other
  modified_base (349)..(349): a, c, t, g, unknown or other
  modified_base (361)..(361): a, c, t, g, unknown or other
  modified_base (389)..(389): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  modified_base (474)..(474): a, c, t, g, unknown or other
  modified_base (487)..(487): a, c, t, g, unknown or other
  modified_base (496)..(496): a, c, t, g, unknown or other
  modified_base (518)..(518): a, c, t, g, unknown or other
  modified_base (533)..(533): a, c, t, g, unknown or other
  modified_base (542)..(542): a, c, t, g, unknown or other
  modified_base (552)..(552): a, c, t, g, unknown or other
  modified_base (601)..(601): a, c, t, g, unknown or other
  modified_base (608)..(608): a, c, t, g, unknown or other
  modified_base (619)..(619): a, c, t, g, unknown or other
  modified_base (625)..(625): a, c, t, g, unknown or other
  modified_base (633)..(633): a, c, t, g, unknown or other
  modified_base (638)..(638): a, c, t, g, unknown or other
  modified_base (641)..(641): a, c, t, g, unknown or other
  modified_base (643)..(643): a, c, t, g, unknown or other
  modified_base (655)..(655): a, c, t, g, unknown or other
  modified_base (682)..(682): a, c, t, g, unknown or other
  modified_base (698)..(698): a, c, t, g, unknown or other
  modified_base (723)..(723): a, c, t, g, unknown or other
  modified_base (752)..(752): a, c, t, g, unknown or other
  modified_base (759)..(759): a, c, t, g, unknown or other
  modified_base (785)..(785): a, c, t, g, unknown or other
aaagttctncttactagaaaaaaggattgtgaattcttcccacttctcacttatcatctgntaagcattttgcagatangacatctagatatgggaaaacataagaaaawtntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactngaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcnttactttgtactctacagtgcttgtttanctcttanggggtttgttctattaaattacactncataataa

SEQ ID NO: 4281 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagaytcanacagctgagattatgatagattcattagtaagctgaatgggraagraaaggatattyacattccnaggccaattttcaatgctttttggaagattctgttaaattc

SEQ ID NO: 4282 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (103)..(103): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (170)..(170): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccanctgagakggtaatttttcccttgggnattagctgctnaggacctggccagcacttttganggcttcncagggataaagacaccaaaggtggmatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 4283 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacygtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4284 - DNA, 816 bp, Artificial Sequence
  Description of Artificial Sequence: Synthetic polynucleotide
  modified_base (67)..(162): a, c, t, g, unknown or other
  modified_base (236)..(236): a, c, t, g, unknown or other
  modified_base (240)..(240): a, c, t, g, unknown or other
  modified_base (259)..(259): a, c, t, g, unknown or other
  modified_base (288)..(288): a, c, t, g, unknown or other
  modified_base (294)..(294): a, c, t, g, unknown or other
  modified_base (298)..(298): a, c, t, g, unknown or other
  modified_base (304)..(304): a, c, t, g, unknown or other
  modified_base (322)..(322): a, c, t, g, unknown or other
  modified_base (335)..(335): a, c, t, g, unknown or other
  modified_base (355)..(355): a, c, t, g, unknown or other
  modified_base (366)..(366): a, c, t, g, unknown or other
  modified_base (372)..(372): a, c, t, g, unknown or other
  modified_base (386)..(386): a, c, t, g, unknown or other
  modified_base (451)..(451): a, c, t, g, unknown or other
  modified_base (477)..(477): a, c, t, g, unknown or other
  modified_base (489)..(489): a, c, t, g, unknown or other
  modified_base (499)..(499): a, c, t, g, unknown or other
  modified_base (504)..(504): a, c, t, g, unknown or other
  modified_base (509)..(509): a, c, t, g, unknown or other
  modified_base (521)..(521): a, c, t, g, unknown or other
  modified_base (531)..(531): a, c, t, g, unknown or other
  modified_base (578)..(578): a, c, t, g, unknown or other
  modified_base (614)..(614): a, c, t, g, unknown or other
  modified_base (678)..(678): a, c, t, g, unknown or other
  modified_base (733)..(733): a, c, t, g, unknown or other
  modified_base (739)..(739): a, c, t, g, unknown or other
  modified_base (759)..(759): a, c, t, g, unknown or other
gtccactccctgagctgmgaataaatggaaagcttacacaggaattgaagaatttgaaaacgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaatgtataacattatacagagaggacagtggtaaactyaggactgctgccctttctatatgatgtaatnttanataagacaaacctataacngtctaatggaccactgtttacagtttgancaccantgcnttaccnatatttccttttaactanatctcataaattnatatgaaaaacccttatagncctattccacntaaggngaaggaaaactagnaagcatgaaaaatgaatattaatttaattaaacttttctataatggctcactgtctgttccagantctgaaaastcccaggtaccagaaanctggaaaaaaantagagccagnaaatnggacnaagaaggactcngcttycatantaaaatactcaacatccttgctgtttttaataatgtggaaagttganaatggtggtggtatkgctggtgggtttgtgtgtasntgcatgtggtgtatataattrtatacatataattacttttagagctcttgcatcttgaaaaacncccatctgtttggtaacattttatgttgtggcactttcctcacatttgaaaatgngaattntgatacaaagacrtgtattntttttttccacactaagattcagaatgttctggcacagatatttctcattcatgtta

SEQ ID NO: 4285 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaagayaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4286 - DNA, 400 bp, Artificial Sequence
  Description of Artificial Sequence: Synthetic polynucleotide
  modified_base (42)..(42): a, c, t, g, unknown or other
  modified_base (103)..(103): a, c, t, g, unknown or other
  modified_base (107)..(107): a, c, t, g, unknown or other
  modified_base (121)..(183): a, c, t, g, unknown or other
  modified_base (354)..(354): a, c, t, g, unknown or other
  modified_base (366)..(366): a, c, t, g, unknown or other
  modified_base (374)..(374): a, c, t, g, unknown or other
  modified_base (395)..(395): a, c, t, g, unknown or other
gcacattatttcctgaatacctattaccacacccaaataccntttagttgttgaatattacttttacccatatgcttacaagaaacttctgttacataatcanttanttacagcacaactnnnnnnnnnnnnnnnnnnnnnnnnnnnnnnnnnnnnnnnnnnnnnnnnnnnnnnnnnnnnnnntgaatcaagtcttattgaacatattttaagtgaaggacttactgctaaaatcacttttaaatggctctttaagtgataggcatttaaaataaatcattaatctaacaatggaagcatcataaattrgttcatttttgatagaaaggacataactgggatgttatgtttctntaagasagtacnagtatttntctttcaaaatatgtacattnaaraa

SEQ ID NO: 4287 - DNA, 133 bp, Artificial Sequence
  Description of Artificial Sequence: Synthetic polynucleotide
  modified_base (65)..(65): a, c, t, g, unknown or other
  misc_feature (100)..(102): This region may encompass 'gag' or is absent in its entirety
ttattccagcatcagtgcaatctgctacacctactaccattaaagttataaatagtagtgygaangcagccaaagtacaaagagcgccgaggatttcaggagaagatagaagctcacctgggaacagaacagg

SEQ ID NO: 4288 - DNA, 426 bp, Artificial Sequence
  Description of Artificial Sequence: Synthetic polynucleotide
  modified_base (19)..(19): a, c, t, g, unknown or other
  modified_base (215)..(215): a, c, t, g, unknown or other
  modified_base (406)..(406): a, c, t, g, unknown or other
gttgggggtggagsggggntgggaggaatgtgagttgggattgtagaattggagttaagataggatmagtttgaagraagagtttacgttttattctttatatctttgatggttttaatttatgtaataatctatatrttatatattgtaagtgaattatttaattcctgttaatgttctctgaaccaaattccaatttcagttctatggtccantgaaatactttagaatggataatctgttatgaaatacaaaatccattttgcttcctctctcttgattttgaaaaatagttgctcttttctgttacgagagactttgtggcaagtgagacgatttttacttatcttttgctgtgtgtattaattttggcaagcccttcttacttggggattaactttttgtntcacagagttctttaatatc

SEQ ID NO: 4289 - DNA, 326 bp, Artificial Sequence
  Description of Artificial Sequence: Synthetic polynucleotide
  modified_base (52)..(52): a, c, t, g, unknown or other
  modified_base (73)..(73): a, c, t, g, unknown or other
  modified_base (169)..(169): a, c, t, g, unknown or other
  misc_feature (182)..(183): This region may encompass 'ta' or is absent in its entirety
  modified_base (253)..(253): a, c, t, g, unknown or other
gagcagcatttcaaggccctccatgctttggtctctgccaaatcactattanatttttaagatttttttttanacattatacttacattacacaatgtcttaacactatgaagtaaaaatgtaaatattttaaactctggcttggaaatgaggaggcagaatctcaganattttcctaaaataaaataggagaggcaagctttctgagtccacaaaagtgccctctacctattgggtcaaagaaaaagtaatntctctatttgtaacaacatacataaattataaaccctgaagaaataggtccctaatagctataatctttaaca

SEQ ID NO: 4290 - DNA, 619 bp, Artificial Sequence
  Description of Artificial Sequence: Synthetic polynucleotide
  modified_base (201)..(201): a, c, t, g, unknown or other
  modified_base (204)..(204): a, c, t, g, unknown or other
  modified_base (222)..(222): a, c, t, g, unknown or other
  modified_base (259)..(259): a, c, t, g, unknown or other
  modified_base (389)..(389): a, c, t, g, unknown or other
  modified_base (423)..(423): a, c, t, g, unknown or other
  modified_base (556)..(556): a, c, t, g, unknown or other
atagagtgattttgaagattaagcaggctagtgggtcaagcacgtagtacaacatttgaagcccaaaggcagggagtgtgagccccaggtggtggtggsggggatgaaaggagaagcagraggcaatggggaasgagrcacttgaractggaactcagggctcttcagagagagaagcttycaggtcctggagaaggggynagncccatgcgagtcccctgnaygctcaaaaggaagggccaggtttccctgacacagngggctcygtggtctcctcccctcctwttcacctcrggagggagggaaagaggggaagagaaggtcctgcagaggaggyaggatggccggttgaggggggccttgggcgctttttcccaagggctgcctcntgyggcwgccccaggggcttccttgaacaagaantccctgctctcccgctgagagccagggtgggtcctctrtccctcaccatgaagttcaatgagtattggagagtccgcatgaggygaaggggcttcagcccaaccrctggtccctgctgcactcactcytcaanaaggaccaccagctgcctgatggtgagcatggagcaggtctgagtggaccagactagggccaa

SEQ ID NO: 4291 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  modified_base (217)..(217): a, c, t, g, unknown or other
  modified_base (276)..(276): a, c, t, g, unknown or other
  modified_base (363)..(363): a, c, t, g, unknown or other
  modified_base (404)..(404): a, c, t, g, unknown or other
  modified_base (406)..(406): a, c, t, g, unknown or other
  modified_base (444)..(444): a, c, t, g, unknown or other
  modified_base (454)..(454): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaanaaagaaatttaagagatttactccaccaatctcttggtaatttttgtgttcattatcantaagctgtgtgcatccttttagagtgctactgtttgagaaaagcarcattgaagttgctgctgatcttggtcatgcattttcagagngtgcttatcagcagacttggatgctgttggggttctstttntnatttgcaatttttccaagacaggctttctgttgcccangctggagtgngtagctgctgtttctcaatagacaagtcctagaagtagarataattcaattttcattcactcttagctcttctgc

SEQ ID NO: 4292 - DNA, 214 bp, Artificial Sequence
  Description of Artificial Sequence: Synthetic polynucleotide
  modified_base (18)..(18): a, c, t, g, unknown or other
  modified_base (85)..(85): a, c, t, g, unknown or other
  modified_base (149)..(149): a, c, t, g, unknown or other
gaaacatctaagaccaanttgatctaggttgaaactagttgggcttcmctgaacttgcacttctgcagtttactgactggagggngttttattatttactggcttgcattgggcaaattatctaacgaggatctgcaccacctttcttnatcttcctggaaacaagagactagctgagatatgtttgtctcatggtagtgaaagaggcacaaat

SEQ ID NO: 4293 - DNA, 2632 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  misc_feature (1197)..(1198): This region may encompass 'ga' or 'ag'
  modified_base (1228)..(1228): a, c, t, g, unknown or other
  modified_base (1231)..(1231): a, c, t, g, unknown or other
  modified_base (1367)..(1367): a, c, t, g, unknown or other
  modified_base (1371)..(1371): a, c, t, g, unknown or other
  modified_base (1424)..(1424): a, c, t, g, unknown or other
  modified_base (1448)..(1448): a, c, t, g, unknown or other
  modified_base (1657)..(1657): a, c, t, g, unknown or other
  modified_base (1683)..(1683): a, c, t, g, unknown or other
  modified_base (1746)..(1746): a, c, t, g, unknown or other
  modified_base (1767)..(1767): a, c, t, g, unknown or other
  modified_base (1911)..(1911): a, c, t, g, unknown or other
  modified_base (1950)..(1950): a, c, t, g, unknown or other
  modified_base (1970)..(1970): a, c, t, g, unknown or other
  modified_base (1992)..(1992): a, c, t, g, unknown or other
  modified_base (2013)..(2013): a, c, t, g, unknown or other
  modified_base (2022)..(2022): a, c, t, g, unknown or other
  modified_base (2047)..(2047): a, c, t, g, unknown or other
  modified_base (2059)..(2059): a, c, t, g, unknown or other
  modified_base (2091)..(2091): a, c, t, g, unknown or other
  modified_base (2109)..(2109): a, c, t, g, unknown or other
  modified_base (2120)..(2120): a, c, t, g, unknown or other
  modified_base (2151)..(2151): a, c, t, g, unknown or other
  modified_base (2322)..(2322): a, c, t, g, unknown or other
  modified_base (2343)..(2343): a, c, t, g, unknown or other
  modified_base (2426)..(2426): a, c, t, g, unknown or other
  modified_base (2438)..(2438): a, c, t, g, unknown or other
  modified_base (2442)..(2442): a, c, t, g, unknown or other
  modified_base (2451)..(2451): a, c, t, g, unknown or other
  modified_base (2498)..(2498): a, c, t, g, unknown or other
  modified_base (2504)..(2504): a, c, t, g, unknown or other
  modified_base (2541)..(2541): a, c, t, g, unknown or other
  modified_base (2565)..(2565): a, c, t, g, unknown or other
  modified_base (2567)..(2567): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatgarracgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4294 - DNA, 215 bp, Artificial Sequence
  Description of Artificial Sequence: Synthetic polynucleotide
  modified_base (32)..(32): a, c, t, g, unknown or other
  modified_base (75)..(75): a, c, t, g, unknown or other
  modified_base (84)..(84): a, c, t, g, unknown or other
  modified_base (91)..(91): a, c, t, g, unknown or other
  modified_base (119)..(119): a, c, t, g, unknown or other
  modified_base (142)..(142): a, c, t, g, unknown or other
  modified_base (193)..(193): a, c, t, g, unknown or other
accaaggtgtgggaagttcagtggcmygactntgcccagcacactggaatgcatgagcttgcctaccgggaaagnagcatgccnaaagggnrtgagattgggagcagctcatctgtcanctgccttttgtttaaggacaacnttggcagctggctcctgctccaccccacttcctaccttcatcctgggagangcctggtccacagggcatcttc

SEQ ID NO: 4295 - DNA, 93 bp, Artificial Sequence
  Description of Artificial Sequence: Synthetic oligonucleotide
  modified_base (2)..(2): a, c, t, g, unknown or other
  modified_base (23)..(23): a, c, t, g, unknown or other
  modified_base (31)..(31): a, c, t, g, unknown or other
cntaaagatgatttcccaagtanggtatttnctaagttgctccagagtsttagggtgcaaaccacagttagtaagctccttatgaacaacctc

SEQ ID NO: 4296 - DNA, 137 bp, Artificial Sequence
  Description of Artificial Sequence: Synthetic polynucleotide
  modified_base (1)..(1): a, c, t, g, unknown or other
  modified_base (30)..(30): a, c, t, g, unknown or other
  modified_base (33)..(33): a, c, t, g, unknown or other
  modified_base (47)..(47): a, c, t, g, unknown or other
  modified_base (49)..(49): a, c, t, g, unknown or other
  modified_base (114)..(114): a, c, t, g, unknown or other
naacttcaakttaacaattaaatcatgtgntanatacagtcctctcnyngtgttkcttaaaattagggatcagaatctcaackagaggaatagaaatattgcctgatttcagangaacacccccttgtattaatttc

SEQ ID NO: 4297 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  modified_base (369)..(369): a, c, t, g, unknown or other
  modified_base (448)..(448): a, c, t, g, unknown or other
  modified_base (510)..(510): a, c, t, g, unknown or other
  modified_base (530)..(530): a, c, t, g, unknown or other
  modified_base (579)..(579): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacntatctgtgggaaaagcatttttagtagaatgcttgcrcatcttcctacattcctgtaatcaaacagtatttatcatcanctatgttggtgactctcactttgacataggctgaaccagaaatcctaggaaaaactgatganagaaagctaaggggaagganaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4298 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcrtgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4299 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcygaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4300 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaamatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4301 - DNA, 245 bp, Artificial Sequence
  Description of Artificial Sequence: Synthetic polynucleotide
  modified_base (6)..(6): a, c, t, g, unknown or other
  modified_base (29)..(29): a, c, t, g, unknown or other
  modified_base (34)..(34): a, c, t, g, unknown or other
  modified_base (41)..(41): a, c, t, g, unknown or other
  modified_base (50)..(50): a, c, t, g, unknown or other
  modified_base (52)..(52): a, c, t, g, unknown or other
  modified_base (77)..(77): a, c, t, g, unknown or other
  modified_base (83)..(83): a, c, t, g, unknown or other
  modified_base (92)..(92): a, c, t, g, unknown or other
  modified_base (115)..(115): a, c, t, g, unknown or other
  modified_base (129)..(129): a, c, t, g, unknown or other
  modified_base (136)..(136): a, c, t, g, unknown or other
  misc_feature (176)..(177): This region may encompass 'ct' or is absent in its entirety
  modified_base (206)..(206): a, c, t, g, unknown or other
  modified_base (217)..(217): a, c, t, g, unknown or other
  modified_base (220)..(220): a, c, t, g, unknown or other
  modified_base (225)..(225): a, c, t, g, unknown or other
  modified_base (241)..(241): a, c, t, g, unknown or other
tccctnttaataaacagttyccactgatnayatnaagggcnggtataaanangtctttaaatgagtaagctttcttnggtaanattaaatmntacaaattatttttaaaaccttntgatatatacaatntttagcnagttttctaattttctggatgtaaaacaaaaggtttaacctatacattccttgagctgttagtgctattnaaatcttttgnccntttangtcctaaacacttttngttg

SEQ ID NO: 4302 - DNA, 351 bp, Artificial Sequence
  Description of Artificial Sequence: Synthetic polynucleotide
  modified_base (12)..(12): a, c, t, g, unknown or other
  modified_base (29)..(29): a, c, t, g, unknown or other
  modified_base (46)..(46): a, c, t, g, unknown or other
  modified_base (87)..(87): a, c, t, g, unknown or other
  modified_base (89)..(89): a, c, t, g, unknown or other
  modified_base (119)..(119): a, c, t, g, unknown or other
  modified_base (140)..(140): a, c, t, g, unknown or other
  modified_base (177)..(177): a, c, t, g, unknown or other
  modified_base (187)..(187): a, c, t, g, unknown or other
  misc_feature (218)..(223): This region may encompass 'gtgaag' or is absent in its entirety
  modified_base (227)..(227): a, c, t, g, unknown or other
  modified_base (242)..(242): a, c, t, g, unknown or other
  modified_base (260)..(260): a, c, t, g, unknown or other
  modified_base (263)..(263): a, c, t, g, unknown or other
  modified_base (286)..(286): a, c, t, g, unknown or other
  modified_base (308)..(308): a, c, t, g, unknown or other
  modified_base (314)..(314): a, c, t, g, unknown or other
  modified_base (316)..(316): a, c, t, g, unknown or other
cataaagcagtntatttttcttaaaaagnaaggtacatggtcacantccaaaatgttttatacagctctcagcytggaaaatgcaantnatgaaaaaggcactgtttctagaacaratngaaaaagaataaatatgtcancatttaccctgcacagctttgagtaacaccataggancctgtcacangttcagggtcaattttaaaagcttgagaaggtgaagacanagcaaggtgatgtcntagactagccaggctccnaanggaagagctgtctgtccctcctnmactgtcctctctctgtcacangtgtcntntcactgttcctctagcagatgtggaaagtggctgc

SEQ ID NO: 4303 - DNA, 744 bp, Artificial Sequence
  Description of Artificial Sequence: Synthetic polynucleotide
  modified_base (58)..(58): a, c, t, g, unknown or other
  modified_base (261)..(261): a, c, t, g, unknown or other
  modified_base (347)..(347): a, c, t, g, unknown or other
  modified_base (356)..(356): a, c, t, g, unknown or other
  modified_base (396)..(396): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacaytcctcccacgacaaagttttaccytcagkaattgtgctcacaacagctttcctcctagagntttctgccnagaacatacacaggtgcctagaagactcctggcttatctnaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 4304 - DNA, 170 bp, Artificial Sequence
  Description of Artificial Sequence: Synthetic polynucleotide
  modified_base (35)..(35): a, c, t, g, unknown or other
  modified_base (39)..(39): a, c, t, g, unknown or other
  modified_base (105)..(105): a, c, t, g, unknown or other
  modified_base (117)..(117): a, c, t, g, unknown or other
  modified_base (134)..(134): a, c, t, g, unknown or other
cccatttttattaattattgaatctggttggattnccanataatgtcttttcatactgctttgcaatacttcagacrtacttgtatggaatctgaacattaatgnttcccatcaggntgaaagaataaagggantaagatagtacactcttgaattacaagctaagtctt

SEQ ID NO: 4305 - DNA, 500 bp, Artificial Sequence
  Description of Artificial Sequence: Synthetic polynucleotide
  modified_base (181)..(181): a, c, t, g, unknown or other
  modified_base (195)..(195): a, c, t, g, unknown or other
  modified_base (280)..(280): a, c, t, g, unknown or other
  modified_base (315)..(315): a, c, t, g, unknown or other
  modified_base (443)..(443): a, c, t, g, unknown or other
cagcatcagcatctctccacaagccttcccagagaaaagggctgctcagaccatcccgctgttagtgagctactgtctggtcatgtgctgggtggacctcatcatctcatcttcttcaaccctgctgtggacgtgtaacccagtcttcctgagtatgcagaaccttgtgggcgatgtctangccactgttgttcnactggaacaaatcagctctgataaaaatatagttgacattctccaaaatatgcaaagtgctataaagctttaacaagttggcganggaaaacatttctaaaaaatagtcttctcctatanttmaattgttcaagtagccctggagttctttttatcttatttaataaaatgcatggaatcatacttttattatatttatatgctttcaaaactgatgcttctaaggaccatgtaatttctttaattcnagtgtctaccatgggttgacatttctgtatcaagtttcttacatttttattttcatt

SEQ ID NO: 4306 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (83)..(83): a, c, t, g, unknown or other
  modified_base (119)..(119): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (271)..(271): a, c, t, g, unknown or other
  modified_base (328)..(328): a, c, t, g, unknown or other
  modified_base (344)..(344): a, c, t, g, unknown or other
  modified_base (383)..(383): a, c, t, g, unknown or other
  modified_base (390)..(390): a, c, t, g, unknown or other
  modified_base (405)..(405): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
  modified_base (489)..(489): a, c, t, g, unknown or other
ctccactgtgtgcagtggaatcctgggaaatttaagagctactctctntangcngagactttgnaggcccattcagaganctnaataaaacaacatggttgcaggtaatggcaacaagntntagctnaaatcacccangacatttagatrtgtattccaggctgttagtttaatgtttgctgtatgtacnatgtagtcntttctgttaattatntttcttaactaatttttagaaagagtactctanttgangttcanaactgataggganaaaggtgggaatgggaatgggaaactgtacaaatatttaatgactctaaatatttgngagaactgaggaaatnwcacatggattatggtgctaaaaaggactgttatctaantgagttntttgtcctgatccanttcctgwtccttatcttattgtactattccatcttctgccacttaaattcacagaaacaaaatgcaagnaaangntntcttncntgccttcccagactgatttaataaaaatggc

SEQ ID NO: 4307 - DNA, 149 bp, Artificial Sequence
  Description of Artificial Sequence: Synthetic polynucleotide
  modified_base (6)..(64): a, c, t, g, unknown or other
  modified_base (69)..(69): a, c, t, g, unknown or other
atcagnnnnnnnnnnnnnnnnnnnnnnnnnnnnnnnnnnnnnnnnnnnnnnnnnnnnnnnnnnncatgnataatataggaaatagacttgaatttaactgctccagtaaggycaaagaccaaaaacctcattacaatgcctacattaga

SEQ ID NO: 4308 - DNA, 1013 bp, Artificial Sequence
  Description of Artificial Sequence: Synthetic polynucleotide
  modified_base (23)..(23): a, c, t, g, unknown or other
  modified_base (42)..(65): a, c, t, g, unknown or other
  modified_base (134)..(134): a, c, t, g, unknown or other
  modified_base (197)..(197): a, c, t, g, unknown or other
  modified_base (251)..(251): a, c, t, g, unknown or other
  modified_base (266)..(266): a, c, t, g, unknown or other
  modified_base (282)..(282): a, c, t, g, unknown or other
  modified_base (285)..(285): a, c, t, g, unknown or other
  modified_base (292)..(292): a, c, t, g, unknown or other
  modified_base (310)..(310): a, c, t, g, unknown or other
  modified_base (338)..(338): a, c, t, g, unknown or other
  modified_base (356)..(356): a, c, t, g, unknown or other
  modified_base (603)..(603): a, c, t, g, unknown or other
  modified_base (606)..(606): a, c, t, g, unknown or other
  modified_base (654)..(654): a, c, t, g, unknown or other
  modified_base (697)..(697): a, c, t, g, unknown or other
  modified_base (715)..(715): a, c, t, g, unknown or other
  modified_base (763)..(763): a, c, t, g, unknown or other
  modified_base (808)..(808): a, c, t, g, unknown or other
  modified_base (816)..(816): a, c, t, g, unknown or other
  modified_base (829)..(829): a, c, t, g, unknown or other
  modified_base (848)..(848): a, c, t, g, unknown or other
  modified_base (855)..(855): a, c, t, g, unknown or other
  modified_base (916)..(951): a, c, t, g, unknown or other
  modified_base (968)..(968): a, c, t, g, unknown or other
  modified_base (988)..(988): a, c, t, g, unknown or other
gcttctaaataactcataaacantaattactgttgtgacacnnnnnnnnnnnnnnnnnnnnnnnngtatacagaataacatttcagtgctattttggcactcaagggtattaatgyattagaaacacagaaaanaatatttktcttcattgataaagtgtaataaccagcttttacaaaacaggtaattttttatanactcccaaggtatctaaatatgtttagtgcattaacagaacccagaattaactncaaatacaacacctnggtagtctaaatgtcnaanagaaagncacgtaaatgtcgaaagnaaaagtacaatcaatctgttgaaaaatntttataacaactcattancataactaatttctgctaaattgttaaaatctaaaatcgcttattttgataccatatggcaagttttgcagaagccttttrcactaaaaataatcttggcagataaaatataatgagaggtaagtatataataacagaaartaatttaaattgaccagcttctcaatgtctttctcattttagaaacaccaatatgttcycttaatcatatctgcaatgaaaaatattatattagctaaactaytanganaagtactggaatatatctaacatactaatttacaatatcatataaagntatcagtgwataaaagaaggaaaataaaacactacatttaggngaacgcttyaaacccatntgttacaattaaatagctaatgaagagcactcggcattaaaagaaaangtttactatatatacacagtctggaatgtatcttcctaaaccaantaaaaagnacttgtaaaatcntagacaatatcaaagaatngatttcnacagggaacttctcaaatgtcaacactcttatacactacacataaaagaaatcaagcaagnnnnnnnnnnnnnnnnnnnnnnnnnnnnnnnnnnnncataagtaacaattacnaagctaattaacatttgggnaggagggataaagtaaacagctctt

SEQ ID NO: 4309 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttsattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4310 - DNA, 177 bp, Artificial Sequence
  Description of Artificial Sequence: Synthetic polynucleotide
  modified_base (22)..(22): a, c, t, g, unknown or other
  misc_feature (58)..(59): This region may encompass 'ca' or 'tg'
  modified_base (66)..(66): a, c, t, g, unknown or other
  modified_base (81)..(81): a, c, t, g, unknown or other
  modified_base (83)..(83): a, c, t, g, unknown or other
  modified_base (95)..(95): a, c, t, g, unknown or other
  modified_base (137)..(137): a, c, t, g, unknown or other
  modified_base (140)..(140): a, c, t, g, unknown or other
  modified_base (169)..(169): a, c, t, g, unknown or other
  modified_base (171)..(171): a, c, t, g, unknown or other
cacagtaagaattacttggaanttttttcctgaaatgaagtgcaggaaagccctgtgyrtcttggnttagtgatggtttcntntctagccaattntttgtatcttaaktttttgttagtaccaaaataatctgttanatnaacagacttttaaaataatttctgtatantnatatat

SEQ ID NO: 4311 - DNA, 78 bp, Artificial Sequence
  Description of Artificial Sequence: Synthetic oligonucleotide
  modified_base (46)..(46): a, c, t, g, unknown or other
  modified_base (54)..(54): a, c, t, g, unknown or other
  modified_base (74)..(74): a, c, t, g, unknown or other
cccaagaactcttcaaatgcacctagtgtcacaagaamagatagtnaaactgtntctgaaaaagtggcttatgntggg

SEQ ID NO: 4312 - DNA, 151 bp, Artificial Sequence
  Description of Artificial Sequence: Synthetic polynucleotide
  modified_base (50)..(50): a, c, t, g, unknown or other
  modified_base (74)..(74): a, c, t, g, unknown or other
cttcctgttttcatttgtaattggaatwttatcaccattttcctttagancatacatcattgggttaccaaaangatctgtctgtgatayctggaaagtgatcatcatgtcatcttccacattcccttcatactccaataaatcttttaaa

SEQ ID NO: 4313 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcstgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4314 - DNA, 100 bp, Artificial Sequence
  Description of Artificial Sequence: Synthetic polynucleotide
  misc_feature (32)..(32): May or may not be present
  modified_base (92)..(92): a, c, t, g, unknown or other
gttttactacgtttttatacttactttttttacttatacttttttgtatttaatttttttcttaaatgctaatgcacatttgttttcttttnattttgtt

SEQ ID NO: 4315 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcsgtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4316 - DNA, 700 bp, Artificial Sequence
  Description of Artificial Sequence: Synthetic polynucleotide
  modified_base (40)..(40): a, c, t, g, unknown or other
  modified_base (59)..(59): a, c, t, g, unknown or other
  modified_base (70)..(70): a, c, t, g, unknown or other
  modified_base (99)..(99): a, c, t, g, unknown or other
  modified_base (133)..(133): a, c, t, g, unknown or other
  modified_base (167)..(167): a, c, t, g, unknown or other
  modified_base (268)..(268): a, c, t, g, unknown or other
  modified_base (381)..(381): a, c, t, g, unknown or other
  modified_base (408)..(408): a, c, t, g, unknown or other
  modified_base (456)..(456): a, c, t, g, unknown or other
  modified_base (485)..(485): a, c, t, g, unknown or other
  modified_base (521)..(521): a, c, t, g, unknown or other
  modified_base (582)..(582): a, c, t, g, unknown or other
  modified_base (630)..(630): a, c, t, g, unknown or other
  modified_base (664)..(664): a, c, t, g, unknown or other
  modified_base (696)..(696): a, c, t, g, unknown or other
tcatgtgtcagttctgttgggcagacttctgtggagaccntaccaggcrtcagcatgtngcacaagaganagtccctgctgggggcagttggtgactcnggagctggtgctccgaagccattagcgctgccangctccttgcagctcatggagtcctgcctgggtgnaggcagtcctggccgtgtgccagctttgctctgcattcaggtggttggagagtctcacattctcactcaggtgtgagacttcatagcacaagtctcagggnaacaggtagcaccctgtttcttaagagcacagtggrttaggtggacacaggcacaccacatgtgtggcagaggcgggcccagccatggcccctcctccctataccggtacaangtgaggaagctctggatggtcctcccngcaccccaggaccatagggtgaggggtctcctgggttgggccccattngcccctagcraggtcaggcctgccggccnctgtcacaaataataagagcagggcaagaggagggncaaaagagatgggtggaggtggaggccagggagggctccccagggcaggggtrgtttaggnaggcgaggggcaagcaggaagctcttggatcwtyccatacagtctccngattgtgaatccttccrgggttctgacctcccyngaaaaacagacaggacacacacccaggcctgnaggc

SEQ ID NO: 4317 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgrgtaggtgtttggcacccaaaatttcactgaagaagaatgctgtttcttantatcaaaccaaagtgcaaagcaatataaattagaggccaagncttctcttgncgntcnatttacttctgtaaaacagattctatgttccttttctatgancantttacatttgaaacattagattttttcactnatgagggaaggaaangggcttctgtnctacttnaagncngngaagctaaggtctccttctcaaagnagagcnggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 4318 - DNA, 144 bp, Artificial Sequence
  Description of Artificial Sequence: Synthetic polynucleotide
  modified_base (19)..(19): a, c, t, g, unknown or other
  modified_base (33)..(33): a, c, t, g, unknown or other
  modified_base (41)..(41): a, c, t, g, unknown or other
  modified_base (74)..(74): a, c, t, g, unknown or other
  modified_base (95)..(95): a, c, t, g, unknown or other
  modified_base (97)..(97): a, c, t, g, unknown or other
  modified_base (114)..(114): a, c, t, g, unknown or other
  modified_base (127)..(127): a, c, t, g, unknown or other
  modified_base (142)..(142): a, c, t, g, unknown or other
gggtcctcgaagcgcacgnaggcgaagggcacnaggccgtncckgytcttgagctcgatctcgcggatgcggcngtacttgtagaacaggtcctncntccttytcgcgcacgtnggtcggaaggttnccccacgtagatgcngc

SEQ ID NO: 4319 - DNA, 149 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (45)..(45): a, c, t, g, unknown or other
  modified_base (51)..(51): a, c, t, g, unknown or other
  modified_base (71)..(71): a, c, t, g, unknown or other
  modified_base (97)..(97): a, c, t, g, unknown or other
  modified_base (106)..(106): a, c, t, g, unknown or other
gatgaagnynacgttatttgctccactttccactgactggaatcntcttanctcatctctgtagatgcctnaatrtcaccaacttctttcttcaagncagcctccncatcatcatcytctccctcacttccagagggctgctgatcctt

SEQ ID NO: 4320 - DNA, 428 bp, Artificial Sequence
  Description of Artificial Sequence: Synthetic polynucleotide
  modified_base (3)..(3): a, c, t, g, unknown or other
  modified_base (49)..(49): a, c, t, g, unknown or other
  modified_base (70)..(70): a, c, t, g, unknown or other
  modified_base (80)..(80): a, c, t, g, unknown or other
  modified_base (158)..(158): a, c, t, g, unknown or other
  modified_base (223)..(223): a, c, t, g, unknown or other
  modified_base (235)..(235): a, c, t, g, unknown or other
  modified_base (242)..(242): a, c, t, g, unknown or other
  modified_base (246)..(246): a, c, t, g, unknown or other
  modified_base (258)..(258): a, c, t, g, unknown or other
  modified_base (260)..(260): a, c, t, g, unknown or other
  modified_base (280)..(280): a, c, t, g, unknown or other
  modified_base (296)..(296): a, c, t, g, unknown or other
  modified_base (308)..(308): a, c, t, g, unknown or other
  modified_base (326)..(326): a, c, t, g, unknown or other
  modified_base (352)..(352): a, c, t, g, unknown or other
  modified_base (378)..(378): a, c, t, g, unknown or other
  modified_base (381)..(381): a, c, t, g, unknown or other
  modified_base (404)..(404): a, c, t, g, unknown or other
ttnctgatttcattttaaccagtacaagatrcaggaagggaagctgccngtgacgttcttgctattcagncatggcctcnaggcagcattattcataaccatgagtagcgtggcctttctgaacakcttctgaaaagcacgtttgttactgcagcttngcagtttacctccttctacrttcagggctcaaaccccgtttaacacacgccccctactgggccantgagaactgctnrtctctncagntccccttccacncngtgtgcaggctccctgtrcncaactcccctcctccngtccctagggcnccgcctgagttcacattntggcctgcactgccagatctccytcnagcctctcaccagctccgtcatcctngangaggcacatctctaagaacactnatgccatcactcaaaaacatttgg

SEQ ID NO: 4321 - DNA, 122 bp, Artificial Sequence
  Description of Artificial Sequence: Synthetic polynucleotide
  modified_base (32)..(32): a, c, t, g, unknown or other
  modified_base (38)..(38): a, c, t, g, unknown or other
  modified_base (106)..(106): a, c, t, g, unknown or other
caggcaaacatcctgtgtctgctttgatgganatctgnaataaragaaggtggcaaccacctgaatttctattggtccatgatagtggccctgatcatygcaaacnttttctctttagggta

SEQ ID NO: 4322 - DNA, 139 bp, Artificial Sequence
  Description of Artificial Sequence: Synthetic polynucleotide
  misc_feature (34)..(35): This region may encompass 'at' or is absent in its entirety
aaaaacatgcaattcacttggacacggcctaacatgtgtatacacatattcacataattacgrgccagaaggtttactcaaaacactttcagagttctctagacctgataaagctatcctctgagagaaaataaacctg

SEQ ID NO: 4323 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtyctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4324 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatycacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4325 - DNA, 200 bp, Artificial Sequence
  Description of Artificial Sequence: Synthetic polynucleotide
  modified_base (123)..(123): a, c, t, g, unknown or other
  modified_base (162)..(162): a, c, t, g, unknown or other
acatttttcacacattttttaaatacacaaaagatatgtagtaaaaacaatggtgtggygaaaacaaaatcttgcaaactagaaaaaagacagtccccggtcccgtgtggtccygtcccgccncggggccagccagctgtaagctccacgcagttcaacaanggcccctcctacaggctcttggcggacgtccagaaccg

SEQ ID NO: 4326 - DNA, 409 bp, Artificial Sequence
  Description of Artificial Sequence: Synthetic polynucleotide
  modified_base (14)..(43): a, c, t, g, unknown or other
  modified_base (65)..(65): a, c, t, g, unknown or other
  modified_base (304)..(304): a, c, t, g, unknown or other
  misc_feature (355)..(356): This region may encompass 'ta' or is absent in its entirety
  modified_base (358)..(358): a, c, t, g, unknown or other
  modified_base (360)..(360): a, c, t, g, unknown or other
  modified_base (365)..(365): a, c, t, g, unknown or other
ttgagttgttatcnnnnnnnnnnnnnnnnnnnnnnnnnnnnnnawttccaagaggtgcccacrtnggctaagtaccaaacagggtactagggaattttayttctgagttaaatgccattctagttgttttttcttcatctccagtaaggttatctttattyaccagttgttacaatagytgtgggtcttgcttctcacagttttatgctrtctgtgctattttctctrctgatcrtcaccacaatcattattgcttatcataattgttatctttattttctcctttaatcaagaatcrgtcttntatctcattattctctttygcaggcttcaggataattatggttggagtgctaantnsgggnaaccagtgcagctaagctctgacrtctttgcatcccttttccat

SEQ ID NO: 4327 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (103)..(103): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccanctgagakggtaatttttcccttgggnattagctgctnaggacctggccagcacttttganggcttcycagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 4328 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatygctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4329 - DNA, 281 bp, Artificial Sequence
  Description of Artificial Sequence: Synthetic polynucleotide
  modified_base (6)..(6): a, c, t, g, unknown or other
  modified_base (24)..(24): a, c, t, g, unknown or other
  modified_base (90)..(90): a, c, t, g, unknown or other
  modified_base (94)..(94): a, c, t, g, unknown or other
  modified_base (132)..(132): a, c, t, g, unknown or other
tgaccntaactactattcaagaanaaaaaaaaactactcattagaacttaaaaacataaaattgtatgttctacaaaaacaaatcaaccntatntacaaccaagtcctactgaactactgaatgttagaacngaaggcctcaccgtggactcaagagctgacatgaggaacgtcaccaccatcctgctctcrtaggagtcctcatcttcaatggacagggtagacactaaaacttgggccatgatccctgcacaagagaagtagtaagaaagtgagtggtg

SEQ ID NO: 4330 - DNA, 412 bp, Artificial Sequence
  Description of Artificial Sequence: Synthetic polynucleotide
  modified_base (116)..(116): a, c, t, g, unknown or other
  modified_base (181)..(181): a, c, t, g, unknown or other
  modified_base (248)..(248): a, c, t, g, unknown or other
  modified_base (260)..(260): a, c, t, g, unknown or other
  modified_base (295)..(295): a, c, t, g, unknown or other
  modified_base (306)..(306): a, c, t, g, unknown or other
  modified_base (345)..(345): a, c, t, g, unknown or other
  modified_base (353)..(353): a, c, t, g, unknown or other
  modified_base (372)..(372): a, c, t, g, unknown or other
  modified_base (393)..(393): a, c, t, g, unknown or other
tacacactgtgaataaaatgtttactagttccatatcctgcttttggataaacatttgatacaccattctatacttactcctctctttgctctattctgactgcctgcacccctcnccgccacccaatcccccaacatatatgccatatatataaacatcaacctgtaaccaccctaatcngccccaaggtcactcraaatgccacctccttcagttactctctyctttgttcaatgcctcctttatnacactgtctgcnttatgcctagccctgggtatgttatttctcttacnacctgaatagnggggaggctcttccaagggaagaccagtttcctccatgntgtggaanggtcaacacacagkaggtnctccaatatttarctgttccngctgttctgtgctccttgg

SEQ ID NO: 4331 - DNA, 146 bp, Artificial Sequence
  Description of Artificial Sequence: Synthetic polynucleotide
  modified_base (8)..(8): a, c, t, g, unknown or other
  modified_base (55)..(55): a, c, t, g, unknown or other
  modified_base (66)..(66): a, c, t, g, unknown or other
  modified_base (75)..(75): a, c, t, g, unknown or other
  modified_base (78)..(78): a, c, t, g, unknown or other
  modified_base (96)..(96): a, c, t, g, unknown or other
caygtgcncctgctgctgtatatcttggcagcaaaaacattaattctctgcctgncatttgctggngtgaaaatntancaaagaaaaaggttggangcaaaacarcaaaaactggaggctgaaaggaagargcaatcagagaaaar

SEQ ID NO: 4332 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgkatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4333 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcwgtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4334 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcmatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4335 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaaragaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4336 - DNA, 516 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  modified_base (184)..(184): a, c, t, g, unknown or other
  modified_base (215)..(215): a, c, t, g, unknown or other
  modified_base (218)..(218): a, c, t, g, unknown or other
  modified_base (243)..(243): a, c, t, g, unknown or other
  modified_base (250)..(250): a, c, t, g, unknown or other
  modified_base (258)..(258): a, c, t, g, unknown or other
  modified_base (272)..(272): a, c, t, g, unknown or other
  modified_base (274)..(274): a, c, t, g, unknown or other
  modified_base (305)..(305): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (335)..(335): a, c, t, g, unknown or other
  modified_base (381)..(381): a, c, t, g, unknown or other
  modified_base (403)..(403): a, c, t, g, unknown or other
  modified_base (441)..(441): a, c, t, g, unknown or other
  modified_base (456)..(456): a, c, t, g, unknown or other
  modified_base (458)..(458): a, c, t, g, unknown or other
  modified_base (477)..(477): a, c, t, g, unknown or other
  modified_base (480)..(480): a, c, t, g, unknown or other
  modified_base (495)..(495): a, c, t, g, unknown or other
  modified_base (500)..(500): a, c, t, g, unknown or other
  modified_base (513)..(513): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagnaagtaaaaggcatcccattagtcttttcagntcntagtcaaggacaatkatcatgaatnaatctgnttactatntacttaacacaagntntgagaagaaaagcatcatagttctgaaatgntgatngntcnctaagccacaaatgagaggnaggtttcccacctatctcagttgataatgtccaaaaacatccttcnccatgcatcagagtagaaaganaatgtacctyctactatgtcaaatggaatagataactncaaartaggaacacntnagaacattctctaacattntancagtctgatgcttcnccttntctgccacttcanara

SEQ ID NO: 4337 - DNA, 263 bp, Artificial Sequence
  Description of Artificial Sequence: Synthetic polynucleotide
  modified_base (195)..(195): a, c, t, g, unknown or other
attcagggtgaggaatacattggctgtatgtgattttyatgtgtgctttagggatttgccccatagctgctcctgaatgtggggtcttagaaaacatctttacccttcaaagcatattctgctgattggctaaattgcagcaggaaaaaatatcagcagctctgtctttatgtcacttgccttcaaagcaaaagntttttcaggcacagtaatttgatttagtctgtgttaaaaatcataaatagcctagaaatamaaaaaaa

SEQ ID NO: 4338 - DNA, 150 bp, Artificial Sequence
  Description of Artificial Sequence: Synthetic polynucleotide
  modified_base (33)..(33): a, c, t, g, unknown or other
aaaataaaagattaatcaatttgactacatacnaaaattgggtttacactctgatgtctaacctatacaasatcccatactaagagccttagtgctacatatatttagacagataaaatttctggaagctctttcagttcctttttcctg

SEQ ID NO: 4339 - DNA, 419 bp, Artificial Sequence
  Description of Artificial Sequence: Synthetic polynucleotide
  modified_base (13)..(13): a, c, t, g, unknown or other
  modified_base (17)..(17): a, c, t, g, unknown or other
  modified_base (27)..(27): a, c, t, g, unknown or other
  modified_base (45)..(45): a, c, t, g, unknown or other
  modified_base (52)..(52): a, c, t, g, unknown or other
  modified_base (55)..(55): a, c, t, g, unknown or other
  modified_base (66)..(66): a, c, t, g, unknown or other
  modified_base (76)..(76): a, c, t, g, unknown or other
  modified_base (120)..(120): a, c, t, g, unknown or other
  modified_base (124)..(124): a, c, t, g, unknown or other
  modified_base (134)..(134): a, c, t, g, unknown or other
  modified_base (138)..(138): a, c, t, g, unknown or other
  modified_base (158)..(158): a, c, t, g, unknown or other
  modified_base (198)..(198): a, c, t, g, unknown or other
  modified_base (238)..(238): a, c, t, g, unknown or other
  modified_base (268)..(268): a, c, t, g, unknown or other
  modified_base (283)..(283): a, c, t, g, unknown or other
  modified_base (285)..(285): a, c, t, g, unknown or other
  modified_base (309)..(309): a, c, t, g, unknown or other
  modified_base (353)..(353): a, c, t, g, unknown or other
  modified_base (370)..(370): a, c, t, g, unknown or other
  modified_base (380)..(380): a, c, t, g, unknown or other
  modified_base (386)..(386): a, c, t, g, unknown or other
  modified_base (394)..(394): a, c, t, g, unknown or other
  modified_base (405)..(405): a, c, t, g, unknown or other
  modified_base (412)..(412): a, c, t, g, unknown or other
aagagmaagaganctanaggccctagnaaaaggcaatggcaaagncagatantgnctttcacyccnccactatctntccagaaaaccccatgtaaaccttgagcacactgcaaagtcatntggncaggtttctnctcnagcaagaaagccccatgccnccctgccagttcactggggcctctcaggcaccattctyancatgagctattggttgggtcwggtatgtaggggagctgcngtgccactgaagtcacgtgataattgtggnctcctggccaggaancngctgatctagcttggggacagrgnggcaggatgtgccaytgattcccttgtgagaaattcctaagaanctactctccatctgcanttaattctcncagganaattaagngattttttttntctcttntctaaag

SEQ ID NO: 4340 - DNA, 421 bp, Artificial Sequence
  Description of Artificial Sequence: Synthetic polynucleotide
  modified_base (46)..(46): a, c, t, g, unknown or other
  modified_base (70)..(70): a, c, t, g, unknown or other
  modified_base (93)..(93): a, c, t, g, unknown or other
  modified_base (134)..(134): a, c, t, g, unknown or other
  modified_base (168)..(168): a, c, t, g, unknown or other
  modified_base (321)..(321): a, c, t, g, unknown or other
  modified_base (337)..(337): a, c, t, g, unknown or other
  modified_base (356)..(356): a, c, t, g, unknown or other
  modified_base (366)..(366): a, c, t, g, unknown or other
caccgaattccagcmtttctgctggtaacaaatgyattggcagganggggccgtgtcaggaagtgcctkncagggtcaggaggtgcccgtccnccgggactgaccctgtcctcgtccttgtctgtagctcygantcagggcccaggtgcagctctctgatggacacanaacacagccagsctgaggcagccagagccaaggcytcgagaaagcctgtgagtagcagcagtgcaggcrgcacccagcctcctgcagaggcctagccttgcccagtktaaggcctgaggccagctggcccccctccttggggtcagtgggagnaggtggccaggacccngcatgctgctaggtctctngtracattgnggtttgatacagcagtgggactggagcagccacgtgcagatggggaggcccccag

SEQ ID NO: 4341 - DNA, 631 bp, Artificial Sequence
  Description of Artificial Sequence: Synthetic polynucleotide
  modified_base (37)..(37): a, c, t, g, unknown or other
  modified_base (58)..(58): a, c, t, g, unknown or other
  modified_base (61)..(61): a, c, t, g, unknown or other
  modified_base (89)..(89): a, c, t, g, unknown or other
  modified_base (102)..(102): a, c, t, g, unknown or other
  modified_base (138)..(138): a, c, t, g, unknown or other
  modified_base (144)..(144): a, c, t, g, unknown or other
  modified_base (148)..(148): a, c, t, g, unknown or other
  modified_base (171)..(171): a, c, t, g, unknown or other
  modified_base (177)..(177): a, c, t, g, unknown or other
  modified_base (191)..(191): a, c, t, g, unknown or other
  modified_base (201)..(201): a, c, t, g, unknown or other
  modified_base (205)..(205): a, c, t, g, unknown or other
  modified_base (215)..(215): a, c, t, g, unknown or other
  modified_base (231)..(231): a, c, t, g, unknown or other
  modified_base (256)..(256): a, c, t, g, unknown or other
  modified_base (295)..(295): a, c, t, g, unknown or other
  modified_base (319)..(319): a, c, t, g, unknown or other
  modified_base (327)..(327): a, c, t, g, unknown or other
  modified_base (353)..(353): a, c, t, g, unknown or other
  modified_base (356)..(356): a, c, t, g, unknown or other
  modified_base (392)..(392): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (447)..(447): a, c, t, g, unknown or other
  modified_base (454)..(454): a, c, t, g, unknown or other
  modified_base (480)..(480): a, c, t, g, unknown or other
  modified_base (486)..(486): a, c, t, g, unknown or other
  modified_base (493)..(493): a, c, t, g, unknown or other
  modified_base (529)..(529): a, c, t, g, unknown or other
  modified_base (546)..(546): a, c, t, g, unknown or other
  modified_base (554)..(554): a, c, t, g, unknown or other
  modified_base (570)..(570): a, c, t, g, unknown or other
  modified_base (575)..(575): a, c, t, g, unknown or other
  modified_base (590)..(590): a, c, t, g, unknown or other
  modified_base (617)..(617): a, c, t, g, unknown or other
  modified_base (620)..(620): a, c, t, g, unknown or other
ctgaaacagcaattgggaggcccattttactggccantatataattmcattagtaagnagnctagcaaagaataatcatatcaatttcntaatcagctgcanccatgctgaatttgaactggcaaactctgatktgtnagttgntagntgtgatcttcatatcactaaaangaacangataccattctaanaactttacanaganatagtctagnagacattgttctgccntggtcacagtaacaaaaaagtggtnaaaatcagttactttataaatactgataatttgcagcantaaggaacaggacattaaaaaaantaaatttncccataggacacctatgactaggaantcnttcctaagagaagccaaagttttaattattcagttncacaactantgtactgggttacntantctaagaaagaaaaggtgctctacagagntttcccncacacacaaagaatcagcrttaattnagcatnatctctntcattcacagatctggcagattcattaactcatttnaaatgaataaggccaanaggatgcnggaaggtgtggctgantgagntccagggctgtatcncagcttattgatggcaccccattaggnaantgaatacraag

SEQ ID NO: 4342 - DNA, 469 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (29)..(29): a, c, t, g, unknown or other
  modified_base (31)..(31): a, c, t, g, unknown or other
  modified_base (39)..(39): a, c, t, g, unknown or other
  modified_base (57)..(57): a, c, t, g, unknown or other
  modified_base (92)..(92): a, c, t, g, unknown or other
  modified_base (99)..(99): a, c, t, g, unknown or other
  modified_base (105)..(105): a, c, t, g, unknown or other
  modified_base (137)..(137): a, c, t, g, unknown or other
  modified_base (143)..(143): a, c, t, g, unknown or other
  modified_base (150)..(150): a, c, t, g, unknown or other
  modified_base (170)..(170): a, c, t, g, unknown or other
  modified_base (173)..(173): a, c, t, g, unknown or other
  modified_base (179)..(179): a, c, t, g, unknown or other
  modified_base (230)..(230): a, c, t, g, unknown or other
  modified_base (252)..(252): a, c, t, g, unknown or other
  modified_base (258)..(258): a, c, t, g, unknown or other
  modified_base (277)..(277): a, c, t, g, unknown or other
  modified_base (291)..(291): a, c, t, g, unknown or other
  modified_base (318)..(318): a, c, t, g, unknown or other
  modified_base (323)..(323): a, c, t, g, unknown or other
  modified_base (325)..(325): a, c, t, g, unknown or other
  modified_base (340)..(340): a, c, t, g, unknown or other
  modified_base (343)..(343): a, c, t, g, unknown or other
  modified_base (346)..(346): a, c, t, g, unknown or other
  modified_base (355)..(355): a, c, t, g, unknown or other
  modified_base (361)..(361): a, c, t, g, unknown or other
  modified_base (382)..(382): a, c, t, g, unknown or other
  modified_base (395)..(395): a, c, t, g, unknown or other
  modified_base (402)..(402): a, c, t, g, unknown or other
  modified_base (407)..(407): a, c, t, g, unknown or other
  modified_base (410)..(410): a, c, t, g, unknown or other
  modified_base (412)..(412): a, c, t, g, unknown or other
  modified_base (423)..(423): a, c, t, g, unknown or other
  modified_base (425)..(425): a, c, t, g, unknown or other
  modified_base (453)..(453): a, c, t, g, unknown or other
  modified_base (467)..(467): a, c, t, g, unknown or other
agcctgacnacacatttnccaaaagcagntnaaaaaaangcaagggtctcaggctcngtcacatccaactcattcttatgtgccagggaganacagagnacattntgtgtatctgttrgattgtgaatyaccacttngcatanagactgntctcaacagtgagattcycntcntgtagnaccctcatgcttcagctaggtgcttacaggtgaakagttactcaaaaatcntcatgtagcaaatttggtttcnaccttnaattagagagactcaggcntgcaccaaggaaangtctagctatgctcttctccagcctcncaccngnctgcrggtcttagcnttnttngtatcactnggtgtnccgggcttttgtttgaatggncaacctggctgcnatcattngcagnccnantcgctctgccngntctgcaytgtctgcttcaaaagtcaggntcaccagagagagnaa

SEQ ID NO: 4343 - DNA, 146 bp, Artificial Sequence
  Description of Artificial Sequence: Synthetic polynucleotide
  modified_base (3)..(3): a, c, t, g, unknown or other
  modified_base (18)..(18): a, c, t, g, unknown or other
  modified_base (40)..(40): a, c, t, g, unknown or other
  modified_base (94)..(94): a, c, t, g, unknown or other
  modified_base (103)..(103): a, c, t, g, unknown or other
  modified_base (109)..(109): a, c, t, g, unknown or other
  modified_base (129)..(129): a, c, t, g, unknown or other
  modified_base (139)..(139): a, c, t, g, unknown or other
tcnctgcaaaaagtagantgaagaggactctgakgaaganagcratcatgatgagatgagtgagcaggaagaggagcttgaggatgaycctacntagtcaaanactatnaagacctggaaaaagcagtncagtcttttnggtatga

SEQ ID NO: 4344 - DNA, 516 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  modified_base (184)..(184): a, c, t, g, unknown or other
  modified_base (215)..(215): a, c, t, g, unknown or other
  modified_base (218)..(218): a, c, t, g, unknown or other
  modified_base (243)..(243): a, c, t, g, unknown or other
  modified_base (250)..(250): a, c, t, g, unknown or other
  modified_base (258)..(258): a, c, t, g, unknown or other
  modified_base (272)..(272): a, c, t, g, unknown or other
  modified_base (274)..(274): a, c, t, g, unknown or other
  modified_base (305)..(305): a, c, t, g, unknown or other
  modified_base (310)..(310): a, c, t, g, unknown or other
  modified_base (312)..(312): a, c, t, g, unknown or other
  modified_base (335)..(335): a, c, t, g, unknown or other
  modified_base (381)..(381): a, c, t, g, unknown or other
  modified_base (403)..(403): a, c, t, g, unknown or other
  modified_base (413)..(413): a, c, t, g, unknown or other
  modified_base (441)..(441): a, c, t, g, unknown or other
  modified_base (456)..(456): a, c, t, g, unknown or other
  modified_base (458)..(458): a, c, t, g, unknown or other
  modified_base (477)..(477): a, c, t, g, unknown or other
  modified_base (480)..(480): a, c, t, g, unknown or other
  modified_base (495)..(495): a, c, t, g, unknown or other
  modified_base (500)..(500): a, c, t, g, unknown or other
  modified_base (513)..(513): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagnaagtaaaaggcatcccattagtcttttcagntcntagtcaaggacaatkatcatgaatnaatctgnttactatntacttaacacaagntntgagaagaaaagcatcatagttctgaaatgntgatngntcyctaagccacaaatgagaggnaggtttcccacctatctcagttgataatgtccaaaaacatccttcnccatgcatcagagtagaaaganaatgtacctnctactatgtcaaatggaatagataactncaaartaggaacacntnagaacattctctaacattntancagtctgatgcttcnccttntctgccacttcanara

SEQ ID NO: 4345 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  modified_base (369)..(369): a, c, t, g, unknown or other
  modified_base (406)..(406): a, c, t, g, unknown or other
  modified_base (448)..(448): a, c, t, g, unknown or other
  modified_base (530)..(530): a, c, t, g, unknown or other
  modified_base (579)..(579): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacntatctgtgggaaaagcatttttagtagaatgcttgcncatcttcctacattcctgtaatcaaacagtatttatcatcanctatgttggtgactctcactttgacataggctgaaccagaaatcctaggaaaaactgatgayagaaagctaaggggaagganaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4346 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgygaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4347 - DNA, 1013 bp, Artificial Sequence
  Description of Artificial Sequence: Synthetic polynucleotide
  modified_base (23)..(23): a, c, t, g, unknown or other
  modified_base (42)..(65): a, c, t, g, unknown or other
  modified_base (116)..(116): a, c, t, g, unknown or other
  modified_base (134)..(134): a, c, t, g, unknown or other
  modified_base (197)..(197): a, c, t, g, unknown or other
  modified_base (251)..(251): a, c, t, g, unknown or other
  modified_base (266)..(266): a, c, t, g, unknown or other
  modified_base (282)..(282): a, c, t, g, unknown or other
  modified_base (285)..(285): a, c, t, g, unknown or other
  modified_base (292)..(292): a, c, t, g, unknown or other
  modified_base (310)..(310): a, c, t, g, unknown or other
  modified_base (338)..(338): a, c, t, g, unknown or other
  modified_base (356)..(356): a, c, t, g, unknown or other
  modified_base (603)..(603): a, c, t, g, unknown or other
  modified_base (606)..(606): a, c, t, g, unknown or other
  modified_base (654)..(654): a, c, t, g, unknown or other
  modified_base (697)..(697): a, c, t, g, unknown or other
  modified_base (715)..(715): a, c, t, g, unknown or other
  modified_base (808)..(808): a, c, t, g, unknown or other
  modified_base (816)..(816): a, c, t, g, unknown or other
  modified_base (829)..(829): a, c, t, g, unknown or other
  modified_base (848)..(848): a, c, t, g, unknown or other
  modified_base (855)..(855): a, c, t, g, unknown or other
  modified_base (916)..(951): a, c, t, g, unknown or other
  modified_base (968)..(968): a, c, t, g, unknown or other
  modified_base (988)..(988): a, c, t, g, unknown or other
gcttctaaataactcataaacantaattactgttgtgacacnnnnnnnnnnnnnnnnnnnnnnnngtatacagaataacatttcagtgctattttggcactcaagggtattaatgnattagaaacacagaaaanaatatttktcttcattgataaagtgtaataaccagcttttacaaaacaggtaattttttatanactcccaaggtatctaaatatgtttagtgcattaacagaacccagaattaactncaaatacaacacctnggtagtctaaatgtcnaanagaaagncacgtaaatgtcgaaagnaaaagtacaatcaatctgttgaaaaatntttataacaactcattancataactaatttctgctaaattgttaaaatctaaaatcgcttattttgataccatatggcaagttttgcagaagccttttrcactaaaaataatcttggcagataaaatataatgagaggtaagtatataataacagaaartaatttaaattgaccagcttctcaatgtctttctcattttagaaacaccaatatgttcycttaatcatatctgcaatgaaaaatattatattagctaaactaytanganaagtactggaatatatctaacatactaatttacaatatcatataaagntatcagtgwataaaagaaggaaaataaaacactacatttaggngaacgcttyaaacccatntgttacaattaaatagctaatgaagagcactcggcattaaaagaaaaygtttactatatatacacagtctggaatgtatcttcctaaaccaantaaaaagnacttgtaaaatcntagacaatatcaaagaatngatttcnacagggaacttctcaaatgtcaacactcttatacactacacataaaagaaatcaagcaagnnnnnnnnnnnnnnnnnnnnnnnnnnnnnnnnnnnncataagtaacaattacnaagctaattaacatttgggnaggagggataaagtaaacagctctt

SEQ ID NO: 4348 - DNA, 214 bp, Artificial Sequence
  Description of Artificial Sequence: Synthetic polynucleotide
  modified_base (7)..(7): a, c, t, g, unknown or other
  modified_base (26)..(26): a, c, t, g, unknown or other
  modified_base (60)..(60): a, c, t, g, unknown or other
  modified_base (68)..(68): a, c, t, g, unknown or other
  modified_base (94)..(94): a, c, t, g, unknown or other
  modified_base (99)..(99): a, c, t, g, unknown or other
  modified_base (103)..(103): a, c, t, g, unknown or other
  modified_base (127)..(127): a, c, t, g, unknown or other
ggtagangttacatccaagaggaaanaatccaggcaaggargcacaagctgatcaagatntgtagttngtggctgccaagttgtggtttttganagatngtcncatcagggaagactatcctcaaanagagattttacgagcattraaggccaaatgttgtgaggaggaactggactttagggctgtggtgatggatgaggtggtgctgacaat

SEQ ID NO: 4349 - DNA, 144 bp, Artificial Sequence
  Description of Artificial Sequence: Synthetic polynucleotide
  modified_base (89)..(89): a, c, t, g, unknown or other
taagtcatttacttctcagttaatttatagaagacagcatttccattastatcttttgaataggtaagagatgaaggacaaaatacttnagacttttaaactatgtttattttatttaaaatcattgctgtgaaaaaaaaacaa

SEQ ID NO: 4350 - DNA, 221 bp, Artificial Sequence
  Description of Artificial Sequence: Synthetic polynucleotide
  modified_base (2)..(2): a, c, t, g, unknown or other
  modified_base (39)..(39): a, c, t, g, unknown or other
  modified_base (63)..(63): a, c, t, g, unknown or other
  modified_base (103)..(103): a, c, t, g, unknown or other
  modified_base (121)..(121): a, c, t, g, unknown or other
  modified_base (131)..(131): a, c, t, g, unknown or other
  modified_base (136)..(136): a, c, t, g, unknown or other
  modified_base (155)..(155): a, c, t, g, unknown or other
  modified_base (178)..(178): a, c, t, g, unknown or other
  modified_base (186)..(186): a, c, t, g, unknown or other
  modified_base (206)..(206): a, c, t, g, unknown or other
gntgaggacagaagggactctaggaatttcagaagactntaactggggagttttgggggaaanaatytattctttgctgactaaccattggttaggtggtggncagggcaggycatagggnaagctttgangggangggctcaaaaatcagtcantgtaggctatgttatacagtgtnccctgctnaggcctcaataagaagaatngtggaaagttctcta

SEQ ID NO: 4351 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgytcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4352 - DNA, 102 bp, Artificial Sequence
  Description of Artificial Sequence: Synthetic polynucleotide
  modified_base (26)..(26): a, c, t, g, unknown or other
  modified_base (37)..(37): a, c, t, g, unknown or other
  misc_feature (67)..(67): May or may not be present
aacctgttcagtgctgccagtcaacngagcgtctgtngagtagcagcgtgggatcaggcagcagggtttttttttccccgttgctttcgttcctttgcagga

SEQ ID NO: 4353 - DNA, 606 bp, Artificial Sequence
  Description of Artificial Sequence: Synthetic polynucleotide
  modified_base (128)..(128): a, c, t, g, unknown or other
  modified_base (135)..(135): a, c, t, g, unknown or other
  modified_base (222)..(222): a, c, t, g, unknown or other
  modified_base (291)..(291): a, c, t, g, unknown or other
  modified_base (348)..(348): a, c, t, g, unknown or other
  modified_base (404)..(404): a, c, t, g, unknown or other
  modified_base (419)..(419): a, c, t, g, unknown or other
  modified_base (592)..(592): a, c, t, g, unknown or other
cctttacccacttttcctaaacaacccctaaaaaactttgctctgaaaagcagggaatatcactgtgcaaagtaagttgcttttctccacggggctatctgtgtaaaacttgccactgagagctctcnctgytcngctgtgacagcccagcctgcaggtgagcttgcttgcactcccacctgatcagagcacgcctcccygggtcagacactcaatatcctngccctgcaggaggccagagggcccatctgctgctcatggccaggctgggccttggggtgcctgaccccnccagagcaagccccttagatgcccrgcagaatcctctctcccctcctgtaccttggnaggtttccccacactatgcccagtgtcaggctgaarttgggatcatggcacagganmctctggggccctcngagaatgaggtgcttgatgatgrgcagaatctgaacgcagcctggacggaggtttgaggtcatcartggacagacagcttgtcccagcacttagaactcagggcagcagagctgcctagctgggcacaacctgggccaccccacagagggcaggagtgggagaggccaaaggnggtgatcccaggac

SEQ ID NO: 4354 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatyagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4355 - DNA, 266 bp, Artificial Sequence
  Description of Artificial Sequence: Synthetic polynucleotide
  modified_base (6)..(6): a, c, t, g, unknown or other
  modified_base (95)..(95): a, c, t, g, unknown or other
  modified_base (103)..(103): a, c, t, g, unknown or other
  modified_base (112)..(112): a, c, t, g, unknown or other
  misc_feature (160)..(161): This region may encompass 'gc' or 'at'
  modified_base (171)..(171): a, c, t, g, unknown or other
  modified_base (176)..(176): a, c, t, g, unknown or other
  modified_base (206)..(206): a, c, t, g, unknown or other
  modified_base (208)..(208): a, c, t, g, unknown or other
  modified_base (210)..(210): a, c, t, g, unknown or other
  modified_base (217)..(217): a, c, t, g, unknown or other
  modified_base (241)..(241): a, c, t, g, unknown or other
aaacanctccaccaactggacgaamctataacttgttgacagctttytctctctggttctcagatgaggaaygatgataaaacaaaaccaaaagncrtcttantgaggaagntcagctccagtggatttctytgagacaacccaagttagatggagctarygggaaaaaanacagnaattctttaaactatcattcaagcaaaacntntnrcctaantgttccttttaaagtagctagacntgttagagattttattgagtggata

SEQ ID NO: 4356 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcratagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4357 - DNA, 100 bp, Artificial Sequence
  Description of Artificial Sequence: Synthetic polynucleotide
  modified_base (26)..(56): a, c, t, g, unknown or other
cactcaataaggtggtattctctccnnnnnnnnnnnnnnnnnnnnnnnnnnnnnnngacaacatctttkaatctacaaaatacatgtgccccactccaga

SEQ ID NO: 4358 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagmagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4359 - DNA, 141 bp, Artificial Sequence
  Description of Artificial Sequence: Synthetic polynucleotide
  modified_base (31)..(31): a, c, t, g, unknown or other
  modified_base (39)..(39): a, c, t, g, unknown or other
  modified_base (80)..(80): a, c, t, g, unknown or other
  modified_base (114)..(114): a, c, t, g, unknown or other
  modified_base (124)..(124): a, c, t, g, unknown or other
acctttctgtgtctgggccatttttggctanaatcatcntarttttcctrgtcctcccacaggtgctctgtctgtgcccntgtaaactgcaagaagagtcttttctgttcatcntaaatgaatngatttcccagaactccc

SEQ ID NO: 4360 - DNA, 500 bp, Artificial Sequence
  Description of Artificial Sequence: Synthetic polynucleotide
  modified_base (229)..(229): a, c, t, g, unknown or other
  modified_base (231)..(231): a, c, t, g, unknown or other
  modified_base (366)..(366): a, c, t, g, unknown or other
taataagatayggaaaattataagaaggcagaaaatacaaaattaggtgtgtgactggatgggtgacatggagaagggttgaagtgcaggatgtaggggacggttgaagtgccggttgaagtgcttgagcatttcatggctacttcctagktgttatttactaggatggggaaaccagatgacagagtrgattacaaagagtcagaaaagagtcagaaaaaaataaaantnatgttttcagtttsagacctataagatttgaggcatcyatggggcttagaagaaagatctrgataaakacatttggagtatgagtagatgacctacatgaggaaaattacatagtgattagaaaataaatatttntaagatagactaaatgggtagaattaagcaacacaaatctatgcagactgctgaaattttgaaaatgaaatcaaaggagagagaaaaacatgggattaagtttctcagttatatatttccaaatttatttcaag

SEQ ID NO: 4361 - DNA, 200 bp, Artificial Sequence
  Description of Artificial Sequence: Synthetic polynucleotide
agtctsgggtaaatcatttttwaaaaggtgaaggagrcggaagaaacaaacaagagccatgatscgtcaatcatgagcttcagtcgtgaaagaaaaggagaaacagctacsckaagacatgtgatgaaatacaaawaatacagacttttgttaataatattgctgatcagtwtttacactacaattwgttattttgttaa

SEQ ID NO: 4362 - DNA, 642 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (138)..(138): a, c, t, g, unknown or other
  modified_base (296)..(296): a, c, t, g, unknown or other
  modified_base (300)..(300): a, c, t, g, unknown or other
  modified_base (314)..(314): a, c, t, g, unknown or other
  modified_base (323)..(323): a, c, t, g, unknown or other
  modified_base (463)..(463): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcatttncttgcaaatagcctaccctttctcttacacgtcctttgacacattttagatggtttngccatacaaaacntttcnattttnagttaaangtaggctnagnaaacatttcaagaaactgaagtgtttcttttttcacctgcttttaatctaaagtcttattatatctggattttaacatttmttaaaagtaatgtcagattataaatgtttggattttattcattttctaaatgattctgactggtttcctacatatanaatnatgaccygcaaaanaagatgtgncctttactttctaattatttgcaactaatctgtactggtttatacatctaggaaactgatgagcaactggtgggagtgtgtatctttttcatatgaagcatgcttctagtggtttactattagacaataatgggttggcntttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4363 - DNA, 919 bp, Artificial Sequence
  Description of Artificial Sequence: Synthetic polynucleotide
  modified_base (184)..(184): a, c, t, g, unknown or other
  modified_base (195)..(195): a, c, t, g, unknown or other
  modified_base (256)..(256): a, c, t, g, unknown or other
  modified_base (316)..(316): a, c, t, g, unknown or other
  modified_base (623)..(623): a, c, t, g, unknown or other
  modified_base (679)..(679): a, c, t, g, unknown or other
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaantgacccctggnagagccaggcgcagcacagacagaaagccctgcctgaaagtgactggagccaagagcctgncactctcggctcattccgtrcagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggnctccttggaaccrgctggacatggcggtgacgggacctagtctgcgagtcgagtcntgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4364 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (103)..(103): a, c, t, g, unknown or other
  modified_base (129)..(129): a, c, t, g, unknown or other
  modified_base (140)..(140): a, c, t, g, unknown or other
  modified_base (170)..(170): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccanctgagakggtaatttttcccttgggnattagctgctnaggacctggccagcacttttgayggcttcncagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 4365 - DNA, 549 bp, Artificial Sequence
  Description of Artificial Sequence: Synthetic polynucleotide
  modified_base (74)..(74): a, c, t, g, unknown or other
  modified_base (80)..(80): a, c, t, g, unknown or other
  modified_base (96)..(96): a, c, t, g, unknown or other
  modified_base (191)..(191): a, c, t, g, unknown or other
  modified_base (224)..(224): a, c, t, g, unknown or other
  modified_base (261)..(261): a, c, t, g, unknown or other
  modified_base (280)..(280): a, c, t, g, unknown or other
  modified_base (479)..(479): a, c, t, g, unknown or other
  modified_base (539)..(539): a, c, t, g, unknown or other
grttggggtgagcctgcttcacgtggcagktgctgctcaaacagaagtgtcttggaggcagggccgggggcacnggctcngggcaagggccgggcncttgctctggaggtgaacctggaggcctgtgccacttggctcaccgggtcatgggtctggcaaggttggggccaggcggccaccctgatggtgcntgtggcttttagggcgaygggtkgcatgaggcntgggaacataggccacctcacgcagatcgccaacgtnctggtgcagaacctggagngggctctgtgcagaygcacatcagcgaggtcatctgaggtgagccccccacccggtcatccttttgctggtcgygggcaccggggctctgaaggagctgctgcccgaggctcccctctgcccgtcagcaggtgctgattgcactgacagtgaaagacccygcagccgtctctgtcctctcacttcccacatyagatctntcctcagggggacctgggtctcatgtgtcagttctgttgggcagacttctgtggagaccntaccaggcrt

SEQ ID NO: 4366 - DNA, 327 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (33)..(33): a, c, t, g, unknown or other
  modified_base (45)..(45): a, c, t, g, unknown or other
  modified_base (53)..(53): a, c, t, g, unknown or other
  modified_base (58)..(58): a, c, t, g, unknown or other
  modified_base (70)..(70): a, c, t, g, unknown or other
  modified_base (81)..(81): a, c, t, g, unknown or other
  modified_base (123)..(123): a, c, t, g, unknown or other
  modified_base (126)..(126): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (151)..(151): a, c, t, g, unknown or other
  modified_base (159)..(159): a, c, t, g, unknown or other
  modified_base (165)..(165): a, c, t, g, unknown or other
  modified_base (168)..(168): a, c, t, g, unknown or other
  modified_base (170)..(170): a, c, t, g, unknown or other
  modified_base (203)..(203): a, c, t, g, unknown or other
  modified_base (208)..(208): a, c, t, g, unknown or other
  modified_base (210)..(210): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (282)..(282): a, c, t, g, unknown or other
  modified_base (292)..(292): a, c, t, g, unknown or other
  modified_base (294)..(294): a, c, t, g, unknown or other
  modified_base (301)..(301): a, c, t, g, unknown or other
  modified_base (321)..(321): a, c, t, g, unknown or other
cactttggcattgtgatttaaaatgtnctncangatgggataatnatatgttnacaanggatataagganagtagacaggnatggtattcttacagccatgttcccaccagggtcaagagaanagnacaaagccnagncangccagggccnttccaaangggccncantncccctctggaggctgctgacctggagacctgcnatggncncrtcttgccagctctccttcctctttctccagangncngcccagccttgctagctatatwttacacccaacngagcagagcnanactgganaataatcaaatgtttccccnttttaa

SEQ ID NO: 4367 - DNA, 1996 bp, Artificial Sequence
  Description of Artificial Sequence: Synthetic polynucleotide
  modified_base (8)..(8): a, c, t, g, unknown or other
  modified_base (118)..(118): a, c, t, g, unknown or other
  modified_base (381)..(381): a, c, t, g, unknown or other
  modified_base (412)..(468): a, c, t, g, unknown or other
  modified_base (617)..(617): a, c, t, g, unknown or other
  modified_base (1246)..(1246): a, c, t, g, unknown or other
  modified_base (1265)..(1265): a, c, t, g, unknown or other
  modified_base (1335)..(1335): a, c, t, g, unknown or other
  modified_base (1386)..(1386): a, c, t, g, unknown or other
  modified_base (1533)..(1533): a, c, t, g, unknown or other
  modified_base (1707)..(1707): a, c, t, g, unknown or other
  modified_base (1709)..(1709): a, c, t, g, unknown or other
  modified_base (1884)..(1884): a, c, t, g, unknown or other
  modified_base (1974)..(1974): a, c, t, g, unknown or other
ataagccnctgtttataagcatggctcactcttactggctgaagagattgayttctcttgcctgccgctcttcatagcctccataaggaatgtttcaggatgtgattatgctgggganttagacacacataagggragacttttgcagagycctgccatagcatcaaaaaacaagatataacaaaaccaggaggcacmgggactagaatgcaggaggctcatcaccttttgtttcccrgyccagttcccacccaggagtactcaaaactctgcccagattcaaaatgcaaaattaaacagaccatatattaacagttgtatatatattttgcacatgaagaaaatcattatagtattacaattgtgtgtgtatatatatangycataatttttcaaatgcttggaaatgacnnnnnnnnnnnnnnnnnnnnnnnnnnnnnnnnnnnnnnnnnnnnnnnnnnnnnnnnnctatgataggggatgtggcatcttgaaggcctagttgggctgcgtgtgccattaaratatacmgggctgcagaaaagtaaaccccaaatagaatattcctttatcccttgaatgttggaaggataattagatcagatatgatcacgttnaattgatcagattggagccagtgctaactcaatcaacttccaattcctaaggcagcagaaagcccagctggagagggaaasttctgctctatctcaccctccctcattcatcctgggagccacaytgtgttctgtagaatttgctcaggattcacaatctgagctgataaacttacctggattatcryaacccttaccattttggtattttctttttgtttctcagtttaaaatgggttgtgaatattactaaygcatcataagttttcagacacccagtatgtcacttgtytgggtccmgtcctaggaaatcaatacctaaattcaaaaartcatcctaagattaatctttgaaagctgcctgtgatgattyggactcactgacctcccttctcttcaacctacagagaaagygaaagagctaccaagtctkagggcacatggacagaaccagaagatgcccagtgaagtgctaggatagggtacagtcccatagctttygggccaaatgagaaggaaaagcagaacctgggaccaggaaagccccagcagctccagactccaggrctctttaccaagactgatgggaggaactaaggcaaagatgagacacctgtcaccaagacacntgtcttggctgcttccacntctgactcagttgtgttgktgtgaatgcaaaactggctctctggctcccaagaatgtataaatccagganagaaaaccaagcatttgggcaccaggcaagaggtctttccagattccccangacttttcagaattccccaaagatactgaaactcagacccattctgaccccaccccaaaaagtatcataaatggaatctgggagccattcagagtctccagcctcctctttggtgaaaatggacttggacctaaaaaggcaccccantgtccacaaggacacaaattcagatgctgagcactggcctcctgccttccgatgacggatcttacctgagtcccatcaaagcccatactgttccccaayctccaccatccagacattaggaacaatccctcagaactgtcttgatgagatgggacaagcagtggtagargtccngnttcagaatggttgcctcatctttcccttctgagaagtctayaccygctggtctgagccttcatcccttacatggcttagcccatgtcccaggaagtgccccctaaaagaaccttctagtatttttctcccctgaagagagggtccatgagacactctatgccaggaaatacatgncctccattctcacatgacttgattgactgataaactgataccctgagaaagaaaaagatgcagggaacatcttgtgtgtggtgaatctgngctcctcagctgtggtgcctgt

SEQ ID NO: 4368 - DNA, 411 bp, Artificial Sequence
  Description of Artificial Sequence: Synthetic polynucleotide
  modified_base (167)..(167): a, c, t, g, unknown or other
  modified_base (169)..(169): a, c, t, g, unknown or other
ctctaagtagyagttattaatctcaacaatcatttatttggcttctgatatatacaagagcccatttgaaattcaaaataaaatatagtttctgatctcaagaaattcaccattcaatggaatagacaagattatatacatataaatagaatgagatttagaagtgncnatagaggtagktacaaaatgctggggaatatagaaaagcatcattctaggggatgggtgagatttctccaggtagacaaaatgggtagttgttcccatcatgggaagggcagtgaaaagacgtgatgtggtgcagcagcagcgtgacacactgcacagccaagaggaggtggaaaagcaaccagggcctgatcacattcacctgttaagaaatttgaatttctattgcagtttgtctcttaa

SEQ ID NO: 4369 - DNA, 115 bp, Artificial Sequence
  Description of Artificial Sequence: Synthetic polynucleotide
  modified_base (6)..(6): a, c, t, g, unknown or other
  modified_base (21)..(21): a, c, t, g, unknown or other
  modified_base (24)..(24): a, c, t, g, unknown or other
  modified_base (99)..(99): a, c, t, g, unknown or other
  modified_base (113)..(113): a, c, t, g, unknown or other
tgatgncagatgagagaccangtngagagaatttggggcctggctgacagtaaacyagctcatgttgctaacctggaggctaccagacatatgagggtngtcagtatagattntc

SEQ ID NO: 4370 - DNA, 144 bp, Artificial Sequence
  Description of Artificial Sequence: Synthetic polynucleotide
  modified_base (22)..(22): a, c, t, g, unknown or other
  modified_base (38)..(38): a, c, t, g, unknown or other
  modified_base (55)..(55): a, c, t, g, unknown or other
  modified_base (129)..(129): a, c, t, g, unknown or other
ataggatggtgtcagcttcccnttacgaagctgatttntcactcagggctcagangttggatcttccaggctgaaagtgggaggagaacacatgttgtkctagtcacagccagagataacacaaagacngcctaacaagggccc

SEQ ID NO: 4371 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcrgtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4372 - DNA, 141 bp, Artificial Sequence
  Description of Artificial Sequence: Synthetic polynucleotide
  modified_base (39)..(39): a, c, t, g, unknown or other
  modified_base (50)..(50): a, c, t, g, unknown or other
  modified_base (80)..(80): a, c, t, g, unknown or other
  modified_base (114)..(114): a, c, t, g, unknown or other
  modified_base (124)..(124): a, c, t, g, unknown or other
acctttctgtgtctgggccatttttggctakaatcatcntarttttcctngtcctcccacaggtgctctgtctgtgcccntgtaaactgcaagaagagtcttttctgttcatcntaaatgaatngatttcccagaactccc

SEQ ID NO: 4373 - DNA, 324 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (37)..(37): a, c, t, g, unknown or other
  modified_base (45)..(45): a, c, t, g, unknown or other
  modified_base (50)..(50): a, c, t, g, unknown or other
  modified_base (120)..(120): a, c, t, g, unknown or other
  modified_base (134)..(134): a, c, t, g, unknown or other
  modified_base (138)..(138): a, c, t, g, unknown or other
  modified_base (143)..(143): a, c, t, g, unknown or other
  modified_base (149)..(149): a, c, t, g, unknown or other
  modified_base (151)..(151): a, c, t, g, unknown or other
  modified_base (159)..(159): a, c, t, g, unknown or other
  modified_base (162)..(162): a, c, t, g, unknown or other
  misc_feature (225)..(226): This region may encompass 'cg' or 'tt'
  modified_base (238)..(238): a, c, t, g, unknown or other
  modified_base (241)..(241): a, c, t, g, unknown or other
  modified_base (252)..(252): a, c, t, g, unknown or other
  modified_base (285)..(285): a, c, t, g, unknown or other
  modified_base (288)..(288): a, c, t, g, unknown or other
  modified_base (310)..(310): a, c, t, g, unknown or other
  modified_base (317)..(317): a, c, t, g, unknown or other
gtnagatctggtagtgcaagncaccttcctcctcctnraatattnatagntaaatggtcagtttctctaaaccagcatataggtagggcaaagaagcattttggatgatagctacaattnagtgaaatgttaancacntgtgnttatantnataattantanccaagtctcttactcagcaatttaattcttagtggcattttatcttgcaaacatttgccacaykttagtatgtganttntttacacctgnctcacttgaatatttggtaaaacattacttttnctntaatcctgttgaagtaataganggaaatntattttc

SEQ ID NO: 4374 - DNA, 101 bp, Artificial Sequence
  Description of Artificial Sequence: Synthetic polynucleotide
  misc_feature (52)..(52): May or may not be present
atcttttattttcatgtggctattgactaggttactgagcaaggaaaataaatcataytcrcaaaaaaattcactcgtgcatattttaaaaggaatttact

SEQ ID NO: 4375 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatytattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4376 - DNA, 415 bp, Artificial Sequence
  Description of Artificial Sequence: Synthetic polynucleotide
  modified_base (107)..(107): a, c, t, g, unknown or other
  modified_base (228)..(228): a, c, t, g, unknown or other
  modified_base (365)..(365): a, c, t, g, unknown or other
  modified_base (379)..(379): a, c, t, g, unknown or other
  modified_base (397)..(397): a, c, t, g, unknown or other
atggaacgtttaaaatttccctggttactttaactgcaaaagtgagtcttgcatgttatattttacctcttccagcagggcatacagagaggagctagtcagaacanttctttttgacatttatatactgagaagtataccrgtgtgttactacagtacatcatggagagtattctatcctttcctttcagttctcatcttttgtcctagattaatagagaacatcangtactgttttcggacagaaaaactaacaagccacctaaacccagtctttctggcctcttaacattaatgttgaactttccttatgcacggtcaacaaagatgcttcaacacttctgtaagcttctccaatcagacantgtgtttcattttntcatctgcaaaaagcagnggaaagagtttccaattt

SEQ ID NO: 4377 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcmaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4378 - DNA, 113 bp, Artificial Sequence
  Description of Artificial Sequence: Synthetic polynucleotide
  modified_base (41)..(41): a, c, t, g, unknown or other
  modified_base (82)..(82): a, c, t, g, unknown or other
agcctgtggacatctctacagcaatgagtgaacgggcactngctcagaaaagactcagtgagaatgcatttgaycttgaagncatgagcatgttaaatagagctcaggaaagg

SEQ ID NO: 4379 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcrttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4380 - DNA, 669 bp, Artificial Sequence
  Description of Artificial Sequence: Synthetic polynucleotide
  modified_base (51)..(51): a, c, t, g, unknown or other
  modified_base (112)..(112): a, c, t, g, unknown or other
  modified_base (116)..(162): a, c, t, g, unknown or other
  modified_base (170)..(170): a, c, t, g, unknown or other
  modified_base (223)..(223): a, c, t, g, unknown or other
  modified_base (229)..(229): a, c, t, g, unknown or other
  modified_base (477)..(477): a, c, t, g, unknown or other
  modified_base (537)..(537): a, c, t, g, unknown or other
  modified_base (629)..(658): a, c, t, g, unknown or other
aaaacagtaaatttttatgatagttttaaagttactaagattgagaatatntcaatttttcactgctcatgaatctgtgggttccttaaacaattatacataaggtctatanatannnnnnnnnnnnnnnnnnnnnnnnnnnnnnnnnnnnnnnnnnnnnnnaatggctnagaatcttgcctaacatattgtatgcactaagcaagtactagtaaaattattnatcaanttatcatcttcataccattcttcaaatggcatattgtttgttctaattaaaaactatgtttctgtcttatgttaagtagcaacaaaaattagaaggtctacttgttctgccctcttgagaaaatccaaagttaaatggtagttttactaatttcctttagattcagtaccttattttcctcacacaaaaatgtaaacattaaggayaacatcatatttaaatgattcatcctacaatagacagacttngggtcattcattgattgggctgaagtctcactcactctctattatttctaattttttcangttaacagcctagaaaatctactacacatggaatgttataaattagaaattaacaccttggatgtacaaattataaaagtaaactgaaaagnnnnnnnnnnnnnnnnnnnnnnnnnnnnnnggattgttatt

SEQ ID NO: 4381 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacayggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4382 - DNA, 100 bp, Artificial Sequence
  Description of Artificial Sequence: Synthetic polynucleotide
  modified_base (3)..(3): a, c, t, g, unknown or other
  modified_base (75)..(75): a, c, t, g, unknown or other
ggncacactgtcatgtccctctctccctgaaaaagagacacatttgcctttgkgcaaggcaatacatacatttgntctatgtatacactttggtctatgc

SEQ ID NO: 4383 - DNA, 411 bp, Artificial Sequence
  Description of Artificial Sequence: Synthetic polynucleotide
  modified_base (85)..(85): a, c, t, g, unknown or other
  modified_base (137)..(137): a, c, t, g, unknown or other
  modified_base (268)..(268): a, c, t, g, unknown or other
  modified_base (360)..(360): a, c, t, g, unknown or other
  modified_base (367)..(367): a, c, t, g, unknown or other
ggataggtaggatttacagactggaaaatgggaaaaagatgagagtggaaaaaggaaggaggggtagcamgaatggcgggcaggnrgacagaaargtaaaattcagccatgttcaaaagggaacaaataaaagcacngaaaggtaagacagacctagtatatttatgacttgaatcccaagctamgaaactggaacataatttagcagagagactccaaaagttttacagcaaaaagtattagaatcatttatatactgggaaaaaantagcctcctcattttaataatccagattgggaaatcagatctaaaacagatgttcaatggacatcccatttcttttgtaaaagcaacttganggtcagncatcaagttttgttctgtttttaattcacaatgaaaatctgact

SEQ ID NO: 4384 - DNA, 71 bp, Artificial Sequence
  Description of Artificial Sequence: Synthetic oligonucleotide
aattatttgtcaataacaacaatgtccatgaaaaacttgattkaaagttaaataagaaaatccttctaaag

SEQ ID NO: 4385 - DNA, 174 bp, Artificial Sequence
  Description of Artificial Sequence: Synthetic polynucleotide
  modified_base (51)..(51): a, c, t, g, unknown or other
  modified_base (146)..(146): a, c, t, g, unknown or other
gaaaaagttatctttttaagtmtctacaaggaatttagaaaatgcaaaatntcttataaatttgaaggktgatatagtasattcactttaactctttctacaggaaactttytcagaatatgaatcaataaaataaataaaaagtnttacttctgtatcttatgtagaaattat

SEQ ID NO: 4386 - DNA, 200 bp, Artificial Sequence
  Description of Artificial Sequence: Synthetic polynucleotide
  modified_base (36)..(36): a, c, t, g, unknown or other
  modified_base (41)..(41): a, c, t, g, unknown or other
  modified_base (70)..(70): a, c, t, g, unknown or other
  modified_base (87)..(87): a, c, t, g, unknown or other
  modified_base (177)..(177): a, c, t, g, unknown or other
gaacctcgagtactgtgggcaatttagaaaaagarnatgcngtttgaaattctgaatttgcraagtactnkaagaataatttatagnaatgagtttaaaamtcaactttttattgccttctcaccagctgcaaagtgttttgtaccagtgaatttttgcaataatgcagtatggtanatttttcaactttgaataaagaa

SEQ ID NO: 4387 - DNA, 472 bp, Artificial Sequence
  Description of Artificial Sequence: Synthetic polynucleotide
  modified_base (126)..(258): a, c, t, g, unknown or other
  modified_base (272)..(272): a, c, t, g, unknown or other
  modified_base (285)..(285): a, c, t, g, unknown or other
  modified_base (301)..(301): a, c, t, g, unknown or other
  modified_base (307)..(307): a, c, t, g, unknown or other
  modified_base (379)..(379): a, c, t, g, unknown or other
  modified_base (382)..(382): a, c, t, g, unknown or other
  modified_base (397)..(397): a, c, t, g, unknown or other
  modified_base (409)..(409): a, c, t, g, unknown or other
gactttgctctatcttttttwcattaaatgagtacrttactcagaaacrtaartaacccattgtagtgatcattgcctacatggggagatttttagcttcaagtaatggatrcacaacccaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtgtaagtccntatttccaaaacngctgcagcctttccangtcttngcagggagaaatgatcatgaccacattctctgaaggagaagaagggaacttcctcccctgagtcycattttnttnaggaaaaaaaaaaanctttttacatgncagccctcaccctgaagacattcacaattctwatttttcaatagcaattaattttattagttt

SEQ ID NO: 4388 - DNA, 222 bp, Artificial Sequence
  Description of Artificial Sequence: Synthetic polynucleotide
  modified_base (15)..(15): a, c, t, g, unknown or other
atgcatacccagccngtgtttaaaacaatccacccatacaactaacagacatcttctatcacaattttatgatggttttgctaaagagtggcaaaatatactcagaaaccaaattagctgatttcgttaaacccattcttcttaatgtcagaagcccttaytccatgttttcaaaattcatgatattgtaaggattgtgaaaaaattcgaaagcaaattaag

SEQ ID NO: 4389 - DNA, 217 bp, Artificial Sequence
  Description of Artificial Sequence: Synthetic polynucleotide
  modified_base (9)..(9): a, c, t, g, unknown or other
  modified_base (22)..(22): a, c, t, g, unknown or other
  modified_base (55)..(55): a, c, t, g, unknown or other
  modified_base (63)..(63): a, c, t, g, unknown or other
  modified_base (107)..(107): a, c, t, g, unknown or other
  modified_base (124)..(124): a, c, t, g, unknown or other
  modified_base (130)..(130): a, c, t, g, unknown or other
  modified_base (139)..(139): a, c, t, g, unknown or other
  modified_base (144)..(144): a, c, t, g, unknown or other
  modified_base (164)..(164): a, c, t, g, unknown or other
  modified_base (196)..(196): a, c, t, g, unknown or other
  modified_base (204)..(204): a, c, t, g, unknown or other
ggtaaagcngtaataaagtccngctgcaacatgggcttcaggtaagagttratangtccatgntgataatgacacattcgtgaaataagatgttccacaaattccantgatctgattcagaccnctggtnaaaatattnaatanacaagtctttttctttttgntagtttccttctgatggcctctttctggagangatcacanatgatgttccatt

SEQ ID NO: 4390 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgktctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4391 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgrtctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4392 - DNA, 94 bp, Artificial Sequence
  Description of Artificial Sequence: Synthetic oligonucleotide
  modified_base (73)..(73): a, c, t, g, unknown or other
aagaactttgaaagtattaacaccatcrtctactgccctttctatgtcatccatcagattgtctgtagagccnygaagtactatggtagaaatg

SEQ ID NO: 4393 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (870)..(870): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacnaaytaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4394 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttccncttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtstnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 4395 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctrttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4396 - DNA, 308 bp, Artificial Sequence
  Description of Artificial Sequence: Synthetic polynucleotide
gttgaagcagtaaatrytcccacttcaataaaagctctctgatataagctatcatttgatgttgactttyagtggctatgaaagacagcctaattaaatgtgttttagagttaaaatcrcaaactatgaagcctgaaatcaaagcggagctaactgtattgagtacacctaaaatataagataagyaaaaaaaaaggaagttccaaaataatatgtacagtgtacaactatttattgaaaatttaagacatraaaacaaattctasacatagtctagaaccacacacatatrtkgtgaatttctgggg

SEQ ID NO: 4397 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancamacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4398 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccwaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4399 - DNA, 370 bp, Artificial Sequence
  Description of Artificial Sequence: Synthetic polynucleotide
  modified_base (24)..(24): a, c, t, g, unknown or other
  modified_base (30)..(30): a, c, t, g, unknown or other
  modified_base (103)..(103): a, c, t, g, unknown or other
  modified_base (131)..(131): a, c, t, g, unknown or other
  modified_base (135)..(135): a, c, t, g, unknown or other
  modified_base (199)..(199): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (351)..(351): a, c, t, g, unknown or other
taaaagagggaagatgacttttcntaaagngtggaataaagaaaagtaagatagcggatagaagcttgaagtgaaagcaggttcacaggaagtttctttggtntttgttttgtttttaaatagtggaaagntgtntatgtttatggagaaagattgccttgaagatgcaagaggmagagatgatcaaaattcaagaagnagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 4400 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttrttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4401 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaarcctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4402 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  misc_feature (286)..(286): May or may not be present
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatcctccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4403 - DNA, 150 bp, Artificial Sequence
  Description of Artificial Sequence: Synthetic polynucleotide
  modified_base (13)..(13): a, c, t, g, unknown or other
  modified_base (30)..(30): a, c, t, g, unknown or other
  modified_base (40)..(40): a, c, t, g, unknown or other
  modified_base (92)..(92): a, c, t, g, unknown or other
  modified_base (99)..(99): a, c, t, g, unknown or other
  modified_base (101)..(101): a, c, t, g, unknown or other
ataaactgtcgangctagcatcccatcctngttgatgttncatttttttcttttcattatatgttgttgtgactattgttatagaaaatttnacacaantntcctctartaaactgtatgttaatactagtggtcagtgttgagaaccag

SEQ ID NO: 4404 - DNA, 182 bp, Artificial Sequence
  Description of Artificial Sequence: Synthetic polynucleotide
  modified_base (12)..(12): a, c, t, g, unknown or other
  modified_base (61)..(61): a, c, t, g, unknown or other
  modified_base (93)..(93): a, c, t, g, unknown or other
  modified_base (120)..(120): a, c, t, g, unknown or other
cgcatgcctgancaataagcttggccagaaatacttcattaccatattgtttacwcattangaggtacgaagtagagatgagacttcatcaanatctcgaaggttttttgcagaacaacntaccaaattaggaagaatctcatgagcttttctgcargctatttcataaccttctatgacct

SEQ ID NO: 4405 - DNA, 505 bp, Artificial Sequence
  Description of Artificial Sequence: Synthetic polynucleotide
  modified_base (7)..(7): a, c, t, g, unknown or other
  modified_base (27)..(27): a, c, t, g, unknown or other
  modified_base (41)..(41): a, c, t, g, unknown or other
  modified_base (114)..(241): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (336)..(336): a, c, t, g, unknown or other
  modified_base (360)..(360): a, c, t, g, unknown or other
  modified_base (406)..(406): a, c, t, g, unknown or other
ccaagcnctggatgttaagaacagaanraagatacaggtangagcttttggccttcaacatgtgtaagtacacrgacaaatacagatgtaaatgtgtgcatgcacacgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttattgcaccatctacatggatgctttctggrgtctttctgttagcttgaaattgcttcaaantgtaantgattttanaacaaaaattttaangaattacagtattatttatctctnctacatcaagcttttctcttgtagtctatcttacaggtacttccanatgaatataaacagatctatyactttgtgtttactggcaacatggatggaatttccagaatggaacagtaggttaattatcttttttataaggcagcaa

SEQ ID NO: 4406 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctycccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4407 - DNA, 524 bp, Artificial Sequence
  Description of Artificial Sequence: Synthetic polynucleotide
  modified_base (285)..(285): a, c, t, g, unknown or other
ttccttatttgaaccagatttatttaataatcacaatctaattttagatagtttctgttttccagaaaatgcaagctagagatcattagagcaattagtacaarataaactttagaatattgcatttggccagaccagatgtaaaatcattagggaataaacataaccatgcttcatagaascccactattcagacattagatgagttttagatcygatgacataatgacaggcctcatttaaaaagactaataacttagtgaaaaccatgtgtatttctacaanactatttgcattttactaatttaatctcacgcattcactgagggtactgacattttagccagtgtgagcatgagaagcaggtgactcatgtatgatctaaatgcaccacatcaagatgactagttgagttgtattcagaagggctgaaataatgtgttattatccaaaacaccatagttatataaaaacaggcagcatagcagatacctgaaaaaatgttttttttggatgaataaggg

SEQ ID NO: 4408 - DNA, 100 bp, Artificial Sequence
  Description of Artificial Sequence: Synthetic polynucleotide
  modified_base (4)..(4): a, c, t, g, unknown or other
taanaaacatcttaggaaaaagaaaacaaaaaataaaatttccctgattacactgtgccttggttcagkaaccctgcactgcacgtatagactataaatg

SEQ ID NO: 4409 - DNA, 3429 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  misc_feature (486)..(488): This region may encompass 'gtc' or is absent in its entirety
  modified_base (562)..(562): a, c, t, g, unknown or other
  modified_base (607)..(607): a, c, t, g, unknown or other
  modified_base (685)..(685): a, c, t, g, unknown or other
  modified_base (739)..(762): a, c, t, g, unknown or other
  modified_base (821)..(821): a, c, t, g, unknown or other
  modified_base (912)..(912): a, c, t, g, unknown or other
  modified_base (978)..(978): a, c, t, g, unknown or other
  modified_base (1063)..(1063): a, c, t, g, unknown or other
  modified_base (1089)..(1089): a, c, t, g, unknown or other
  modified_base (1177)..(1177): a, c, t, g, unknown or other
  modified_base (1236)..(1236): a, c, t, g, unknown or other
  modified_base (1243)..(1243): a, c, t, g, unknown or other
  modified_base (1286)..(1286): a, c, t, g, unknown or other
  modified_base (1291)..(1291): a, c, t, g, unknown or other
  modified_base (1324)..(1324): a, c, t, g, unknown or other
  modified_base (1327)..(1327): a, c, t, g, unknown or other
  modified_base (1362)..(1362): a, c, t, g, unknown or other
  modified_base (1371)..(1371): a, c, t, g, unknown or other
  modified_base (1424)..(1424): a, c, t, g, unknown or other
  modified_base (1507)..(1507): a, c, t, g, unknown or other
  modified_base (1518)..(1518): a, c, t, g, unknown or other
  modified_base (1644)..(1644): a, c, t, g, unknown or other
  modified_base (1701)..(1701): a, c, t, g, unknown or other
  modified_base (1806)..(1806): a, c, t, g, unknown or other
  modified_base (1810)..(1810): a, c, t, g, unknown or other
  modified_base (1841)..(1841): a, c, t, g, unknown or other
  modified_base (1856)..(1856): a, c, t, g, unknown or other
  modified_base (1886)..(1886): a, c, t, g, unknown or other
  modified_base (1894)..(1894): a, c, t, g, unknown or other
  modified_base (1997)..(1997): a, c, t, g, unknown or other
  modified_base (2048)..(2048): a, c, t, g, unknown or other
  modified_base (2105)..(2105): a, c, t, g, unknown or other
  modified_base (2160)..(2160): a, c, t, g, unknown or other
  modified_base (2288)..(2288): a, c, t, g, unknown or other
  modified_base (2306)..(2306): a, c, t, g, unknown or other
  modified_base (2320)..(2320): a, c, t, g, unknown or other
  modified_base (2358)..(2358): a, c, t, g, unknown or other
  modified_base (2434)..(2434): a, c, t, g, unknown or other
  modified_base (2465)..(2465): a, c, t, g, unknown or other
  modified_base (2492)..(2492): a, c, t, g, unknown or other
  modified_base (2495)..(2495): a, c, t, g, unknown or other
  modified_base (2589)..(2589): a, c, t, g, unknown or other
  modified_base (2650)..(2650): a, c, t, g, unknown or other
  modified_base (2837)..(2837): a, c, t, g, unknown or other
  modified_base (2884)..(2884): a, c, t, g, unknown or other
  modified_base (2917)..(2917): a, c, t, g, unknown or other
  modified_base (2935)..(2935): a, c, t, g, unknown or other
  modified_base (2958)..(2958): a, c, t, g, unknown or other
  modified_base (2960)..(2960): a, c, t, g, unknown or other
  modified_base (2972)..(2972): a, c, t, g, unknown or other
  modified_base (3008)..(3008): a, c, t, g, unknown or other
  modified_base (3030)..(3030): a, c, t, g, unknown or other
  modified_base (3104)..(3104): a, c, t, g, unknown or other
  modified_base (3385)..(3385): a, c, t, g, unknown or other
  modified_base (3412)..(3412): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttgtcaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4410 - DNA, 162 bp, Artificial Sequence
  Description of Artificial Sequence: Synthetic polynucleotide
  modified_base (27)..(27): a, c, t, g, unknown or other
  modified_base (72)..(72): a, c, t, g, unknown or other
  modified_base (133)..(133): a, c, t, g, unknown or other
  modified_base (139)..(139): a, c, t, g, unknown or other
gataaggctcaattacttgaaatagcnaaarctaatgcagctgccatgtgtgctaaggctggtgtccctttnccrccaaacctaaagcctgcacctccacctactatagwwgagaaagttgctaaaaagtcangagganctactatagaagaactaactgag

SEQ ID NO: 4411 - DNA, 271 bp, Artificial Sequence
  Description of Artificial Sequence: Synthetic polynucleotide
  modified_base (4)..(4): a, c, t, g, unknown or other
  modified_base (21)..(21): a, c, t, g, unknown or other
  modified_base (25)..(25): a, c, t, g, unknown or other
  modified_base (30)..(30): a, c, t, g, unknown or other
  modified_base (34)..(34): a, c, t, g, unknown or other
  modified_base (42)..(42): a, c, t, g, unknown or other
  modified_base (47)..(47): a, c, t, g, unknown or other
  modified_base (74)..(74): a, c, t, g, unknown or other
  modified_base (76)..(76): a, c, t, g, unknown or other
  modified_base (91)..(91): a, c, t, g, unknown or other
  modified_base (100)..(100): a, c, t, g, unknown or other
  modified_base (150)..(150): a, c, t, g, unknown or other
  modified_base (152)..(152): a, c, t, g, unknown or other
  modified_base (177)..(177): a, c, t, g, unknown or other
  modified_base (187)..(187): a, c, t, g, unknown or other
  modified_base (201)..(201): a, c, t, g, unknown or other
  modified_base (214)..(214): a, c, t, g, unknown or other
  modified_base (218)..(218): a, c, t, g, unknown or other
  modified_base (266)..(266): a, c, t, g, unknown or other
aaanaggtatataccagcctnctcnggaanctgntggtggancttangactggaaactgttgaaagttaaaaananttcccaaaccttgancatctactngacaaatttratgtgtaccagggacaaatgaaagtatccttccaaaatangncccaaattattgtcaagcctttctntaataaaggnccattcctcaagcngctgtcacataangtgnaggtgatcaacagcaaatccattagcaacacaggataaagaaatttgnrtagc

SEQ ID NO: 4412 - DNA, 236 bp, Artificial Sequence
  Description of Artificial Sequence: Synthetic polynucleotide
  modified_base (2)..(2): a, c, t, g, unknown or other
  modified_base (127)..(127): a, c, t, g, unknown or other
  modified_base (129)..(129): a, c, t, g, unknown or other
gngtctgcggatcartggagagctaatcactgcctacccacaagtggtggtagtcagagtaccaaccccttgggtgcaaagtgatagtgacatcactgttttgcgccatctagagaagatgggatgncngttaatgaaccgacytcaagccatcctgaactgcgttaataagttctggacatttcaagagttggctggccayggtgttcctctgccrgatactttctcttatggtg

SEQ ID NO: 4413 - DNA, 186 bp, Artificial Sequence
  Description of Artificial Sequence: Synthetic polynucleotide
  modified_base (5)..(5): a, c, t, g, unknown or other
  modified_base (48)..(48): a, c, t, g, unknown or other
  modified_base (55)..(55): a, c, t, g, unknown or other
  modified_base (66)..(66): a, c, t, g, unknown or other
  modified_base (97)..(97): a, c, t, g, unknown or other
  modified_base (119)..(119): a, c, t, g, unknown or other
  modified_base (143)..(143): a, c, t, g, unknown or other
  modified_base (145)..(145): a, c, t, g, unknown or other
  modified_base (169)..(169): a, c, t, g, unknown or other
tctgntctggaagctttttattgttgctccaagtttaagaattttcantgatkgnagaaaaccaanacttttagacaayctcccgcatagccctgcncagcttctgaatcttggtcttnacagacatktcaacatatttctcncnaatgcgcacmatcattccacccangattgacggatcagtct

SEQ ID NO: 4414 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagycatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4415 - DNA, 246 bp, Artificial Sequence
  Description of Artificial Sequence: Synthetic polynucleotide
  modified_base (23)..(23): a, c, t, g, unknown or other
  modified_base (27)..(27): a, c, t, g, unknown or other
  modified_base (58)..(58): a, c, t, g, unknown or other
  modified_base (67)..(67): a, c, t, g, unknown or other
  modified_base (77)..(77): a, c, t, g, unknown or other
  modified_base (83)..(83): a, c, t, g, unknown or other
  modified_base (138)..(138): a, c, t, g, unknown or other
  modified_base (161)..(161): a, c, t, g, unknown or other
  modified_base (178)..(178): a, c, t, g, unknown or other
  modified_base (198)..(198): a, c, t, g, unknown or other
  modified_base (202)..(202): a, c, t, g, unknown or other
  modified_base (220)..(220): a, c, t, g, unknown or other
  modified_base (232)..(232): a, c, t, g, unknown or other
  modified_base (244)..(244): a, c, t, g, unknown or other
agtatgagaatgcccttcatcantgcngcagcccatgaaggcttccaaataattctgntctctgctncctccagctncagcanaagggagctaggtcagagacaacttgaacakttcayaaarcattgttatgaaganaaatgaaaaccaggcaacaagtntattctcttagcttgtngttggcyaattgtttgcttntggnggaatgacttttgaaganttgatctagagntggaatccacantc

SEQ ID NO: 4416 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtyccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4417 - DNA, 886 bp, Artificial Sequence
  Description of Artificial Sequence: Synthetic polynucleotide
  modified_base (77)..(77): a, c, t, g, unknown or other
  modified_base (85)..(85): a, c, t, g, unknown or other
  modified_base (117)..(153): a, c, t, g, unknown or other
  modified_base (237)..(237): a, c, t, g, unknown or other
  modified_base (365)..(365): a, c, t, g, unknown or other
  modified_base (391)..(391): a, c, t, g, unknown or other
  modified_base (399)..(422): a, c, t, g, unknown or other
  modified_base (441)..(441): a, c, t, g, unknown or other
  modified_base (461)..(461): a, c, t, g, unknown or other
  modified_base (466)..(466): a, c, t, g, unknown or other
  modified_base (574)..(574): a, c, t, g, unknown or other
  modified_base (603)..(603): a, c, t, g, unknown or other
  modified_base (627)..(627): a, c, t, g, unknown or other
  modified_base (666)..(666): a, c, t, g, unknown or other
  modified_base (676)..(676): a, c, t, g, unknown or other
  modified_base (684)..(684): a, c, t, g, unknown or other
  modified_base (695)..(695): a, c, t, g, unknown or other
  modified_base (739)..(739): a, c, t, g, unknown or other
  modified_base (752)..(752): a, c, t, g, unknown or other
  modified_base (756)..(756): a, c, t, g, unknown or other
gtgcactgtcacttgagaatttcaaattatatgataagtagctaaggcagtcaaagaaaggctttggagatgaccanaaagtacnttatgtaactaagttattcagtccctaaaccnnnnnnnnnnnnnnnnnnnnnnnnnnnnnnnnnnnnngatacaggaaaaaagagcttgtcaaaaaatctcaaaagaataaagtctattggatttaaaccatttccttataaaacctgattnctgtattacagatatgaactctataygcactcaaatcctttcatcaataaaaggcaataagactcttattgagtaacaataagaggcaataaggctcttattgactgtaacattatttaggatagttntttccaatagaaatatcaagaccaangggttacnnnnnnnnnnnnnnnnnnnnnnnngtcagtactataccatcanctctgcaaggtaactgctcngaaanagagcctgaggaatcttttctgatcacagatcttttggttttcccttgcccagttcgacttctttgccgcaccataaatccaccaatacctatccaaaaaagaaattnggtaaactgataartaatttctccctacntttccacagtacacaggataaaantgctttatcttgaatagtaagtcattttccaaaattaantctgtgctantctaaatnaataacctganttttaggtaaaatagaagttaaaaacraccaaaaaaaaaaaaangrcaaagccactnttancacttatcaaacagaatacaaaaagacctgtgtgcacttcctcttctcaacagtatcagtgtaaatatcaaacactaaattacgctggcttatctatttgacaaatattagtgcctcatacatcacataa

SEQ ID NO: 4418 - DNA, 306 bp, Artificial Sequence
  Description of Artificial Sequence: Synthetic polynucleotide
  modified_base (15)..(15): a, c, t, g, unknown or other
  modified_base (61)..(61): a, c, t, g, unknown or other
  misc_feature (104)..(106): This region may encompass 'cga' or 'tag'
  modified_base (178)..(178): a, c, t, g, unknown or other
  modified_base (189)..(189): a, c, t, g, unknown or other
  modified_base (203)..(203): a, c, t, g, unknown or other
  modified_base (214)..(214): a, c, t, g, unknown or other
  modified_base (265)..(296): a, c, t, g, unknown or other
ccttcatagaacagnataaaaagattaagtatccaatagtattcccagaaattatgtaatnctgtcactctcaaaagagaatagcagattacaaagagcaaatyrraaagaagcacaccaaaggggagacagaacaagctgagaaagacacccagaattctctaccagttctcaaganaatgaaaaccntaataaagaagatnaagagcaaganacaaaaattatccagtagttactagatattattagagagtgtaaagaaggnnnnnnnnnnnnnnnnnnnnnnnnnnnnnnnnggtgctgggg

SEQ ID NO: 4419 - DNA, 179 bp, Artificial Sequence
  Description of Artificial Sequence: Synthetic polynucleotide
  modified_base (2)..(2): a, c, t, g, unknown or other
  modified_base (4)..(4): a, c, t, g, unknown or other
  modified_base (30)..(30): a, c, t, g, unknown or other
  modified_base (48)..(48): a, c, t, g, unknown or other
  modified_base (119)..(119): a, c, t, g, unknown or other
  modified_base (130)..(130): a, c, t, g, unknown or other
  modified_base (145)..(145): a, c, t, g, unknown or other
  modified_base (147)..(147): a, c, t, g, unknown or other
  modified_base (153)..(153): a, c, t, g, unknown or other
  modified_base (177)..(177): a, c, t, g, unknown or other
anrntttcttaatggaaagaatttgttatnagtttaggccacaagccngaatctttgaaacagcatgactcagatagytcatcactcagagaattayggttttgcatccctcggttctnagtgaggtttncttcctcttttgagnanagcagnattaaattaccagagccatctcangg

SEQ ID NO: 4420 - DNA, 722 bp, Artificial Sequence
  Description of Artificial Sequence: Synthetic polynucleotide
  modified_base (12)..(12): a, c, t, g, unknown or other
  modified_base (32)..(32): a, c, t, g, unknown or other
  modified_base (60)..(60): a, c, t, g, unknown or other
  modified_base (76)..(76): a, c, t, g, unknown or other
  modified_base (79)..(79): a, c, t, g, unknown or other
  modified_base (96)..(96): a, c, t, g, unknown or other
  modified_base (118)..(118): a, c, t, g, unknown or other
  modified_base (152)..(152): a, c, t, g, unknown or other
  modified_base (218)..(218): a, c, t, g, unknown or other
  modified_base (225)..(225): a, c, t, g, unknown or other
  modified_base (233)..(233): a, c, t, g, unknown or other
  modified_base (243)..(243): a, c, t, g, unknown or other
  modified_base (245)..(245): a, c, t, g, unknown or other
  modified_base (284)..(284): a, c, t, g, unknown or other
  modified_base (293)..(293): a, c, t, g, unknown or other
  modified_base (298)..(335): a, c, t, g, unknown or other
  modified_base (339)..(339): a, c, t, g, unknown or other
  modified_base (359)..(359): a, c, t, g, unknown or other
  modified_base (387)..(387): a, c, t, g, unknown or other
  modified_base (394)..(394): a, c, t, g, unknown or other
  modified_base (407)..(407): a, c, t, g, unknown or other
  modified_base (438)..(438): a, c, t, g, unknown or other
  modified_base (444)..(444): a, c, t, g, unknown or other
  modified_base (541)..(541): a, c, t, g, unknown or other
  modified_base (574)..(574): a, c, t, g, unknown or other
  modified_base (579)..(579): a, c, t, g, unknown or other
  modified_base (593)..(593): a, c, t, g, unknown or other
  modified_base (609)..(609): a, c, t, g, unknown or other
  modified_base (626)..(626): a, c, t, g, unknown or other
  modified_base (670)..(670): a, c, t, g, unknown or other
  modified_base (672)..(672): a, c, t, g, unknown or other
  modified_base (694)..(694): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
atggaccaaggngaagtaaattttgtgtttgnagtacctttaattctttctgtccatccnaaatattctaaccccnaancccatgccatgagtggnttttagggaaagaattaagacnatgttgtaaaatcttgtaagttgcagtttgcagnattagtattggaccaacaatgtcctcccactcaagtggcataacrgtagaaaacactgttactagntagaaanagaatstnaggggagaancnatagtctaaactacagaacccagrttaaaatagaaaaantctgtactnttccnnnnnnnnnnnnnnnnnnnnnnnnnnnnnnnnnnnnnnctgnaaataaacagtattataaantggtatatttaaacaaataaatatctanctacaangtaattctttttnatctaatcttgaaccagtggttctggctccntcttancttgtcataatctttgtaactcatcttgaatgcttttttggagttgcacctgttccttggtttatatatgctccagggatttcttgtcagctggccntaagacatgatttggcaatttgtcattccattnactgnattcatttagctgntaaaattgacacttanggatastttagtttcangaatccttcttataacagtgggctttcacaatmtccttcctatncntgcagaaataatcctccacaancnaagcacaaaagaaaaatnagnttggt

SEQ ID NO: 4421 - DNA, 150 bp, Artificial Sequence
  Description of Artificial Sequence: Synthetic polynucleotide
  modified_base (71)..(96): a, c, t, g, unknown or other
gggaactgttaagaaactctaaggaagtgaatggatcttacrtggccttatggtattctttgcagagatcnnnnnnnnnnnnnnnnnnnnnnnnnncaacagaacagcatttcatctctaaatttttatktaacattaaagtcacaaatt

SEQ ID NO: 4422 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcastcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4423 - DNA, 285 bp, Artificial Sequence
  Description of Artificial Sequence: Synthetic polynucleotide
  modified_base (12)..(12): a, c, t, g, unknown or other
  modified_base (17)..(17): a, c, t, g, unknown or other
  modified_base (21)..(21): a, c, t, g, unknown or other
  modified_base (68)..(68): a, c, t, g, unknown or other
  modified_base (121)..(121): a, c, t, g, unknown or other
  modified_base (143)..(143): a, c, t, g, unknown or other
  modified_base (178)..(178): a, c, t, g, unknown or other
  modified_base (221)..(221): a, c, t, g, unknown or other
  modified_base (242)..(242): a, c, t, g, unknown or other
  modified_base (266)..(266): a, c, t, g, unknown or other
  modified_base (269)..(269): a, c, t, g, unknown or other
  modified_base (280)..(280): a, c, t, g, unknown or other
  modified_base (282)..(282): a, c, t, g, unknown or other
  modified_base (284)..(285): a, c, t, g, unknown or other
tttttttctacntacanacangtcttatctacaaaccaaaaacatctrgaaaaatatacaaaaaaagnttccagtgataacctctggggagtaaaactgaacttgtgatgtataccttttnttagaatttgaatttatgaaangcacatatacctttagaataaaaaatactttaaangctctatcatttacagtaatgcaaagygatccaactctsaaantcccacataatcatgttatgnagtgaagctttctaggctgggggnaanaaatgtaaccncncnn

SEQ ID NO: 4424 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttrtccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4425 - DNA, 1484 bp, Artificial Sequence
  Description of Artificial Sequence: Synthetic polynucleotide
  modified_base (66)..(66): a, c, t, g, unknown or other
  modified_base (133)..(133): a, c, t, g, unknown or other
  modified_base (142)..(142): a, c, t, g, unknown or other
  modified_base (214)..(214): a, c, t, g, unknown or other
  modified_base (267)..(267): a, c, t, g, unknown or other
  modified_base (329)..(329): a, c, t, g, unknown or other
  modified_base (353)..(353): a, c, t, g, unknown or other
  modified_base (416)..(416): a, c, t, g, unknown or other
  modified_base (637)..(637): a, c, t, g, unknown or other
  modified_base (646)..(646): a, c, t, g, unknown or other
  modified_base (684)..(684): a, c, t, g, unknown or other
  modified_base (703)..(703): a, c, t, g, unknown or other
  modified_base (722)..(722): a, c, t, g, unknown or other
  modified_base (887)..(887): a, c, t, g, unknown or other
  modified_base (935)..(935): a, c, t, g, unknown or other
  misc_feature (984)..(984): May or may not be present
  modified_base (1022)..(1022): a, c, t, g, unknown or other
  modified_base (1052)..(1052): a, c, t, g, unknown or other
  modified_base (1127)..(1127): a, c, t, g, unknown or other
  modified_base (1203)..(1203): a, c, t, g, unknown or other
  modified_base (1299)..(1299): a, c, t, g, unknown or other
  modified_base (1343)..(1343): a, c, t, g, unknown or other
  modified_base (1366)..(1366): a, c, t, g, unknown or other
  modified_base (1376)..(1376): a, c, t, g, unknown or other
  modified_base (1476)..(1476): a, c, t, g, unknown or other
  modified_base (1482)..(1482): a, c, t, g, unknown or other
attttagtatatasgttctaatatttggggtattcctagaaatgtgtacctattattcacttgctnatatatatagcaaagtgaattttatatataattcttcaacatatttttagaaaaattaagttttttntagaaaatnaagagaattttagataaaaactcaacttttaatggaaaatattktcctttttctttctcacatgaaatyctntatcaaggttagtatcctacctggyatctctccaatastgggttaagagtttnttcttctcaagtaacctgtattatattaagatgatattaactgaaataatcagatagatgantgcrycataaagctaattctaagntatctgtccttagccaaaagcagaaaagggatacacataactyccacataaaacatccacccncatttttttggttattcttaaaagctcataatgtatacaatgataaaatttattgtttcaaattagggtttttgaaattgaaatattaatttaaacacgtttgcttaacacaactttaaagttaataagaaaacactgchtattacagaagagttaaatacttcaaaaagtgggaaaraatttaaaagctttcatttkagtaggagtaaacacagacacantaagaatcntagttggatacactkaaatcatgtcttttaagaacatnagaacagattatttgcttnctctttagtccaaaacctnggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaagntgagtcaataaggtgaaccagattctggttgaatggaatccttgaaanataactttggtgaacaaactgtttgtgttttccacttttcttaaaaaaagaagtgataaagcagatttccagtacctgccarctganaaaatgytacttaccaggtaaaaaccaytnccaaaaatcagaatcacagaagggctatcagtaaaaytaytaatgccacaaattaacatgatgttaacwgctganttatgcatcaaaagagtatttatataatcacagcaaataactcaaatcttttacatcactagtaaactcaaaaaanatagmaaaaagcaataacattaaatttcmttattgatctactagctttaactatttaatactagtacacttagttttgattactttgaaattgaancaaaaacaataatcttttcttcttttaatgactttttcagttanaggaaagatgatattaaaagaanatatacaacnatagcttagctacaggtataaaaytgttttaaagatatgtaattgtgctattgaattaaactgaaaacataaatatcaactcatgattttgaaaaaaaantctttnat

SEQ ID NO: 4426 - DNA, 352 bp, Artificial Sequence
  Description of Artificial Sequence: Synthetic polynucleotide
  misc_feature (144)..(146): This region may encompass 'aaa' or is absent in its entirety
  modified_base (187)..(233): a, c, t, g, unknown or other
  modified_base (237)..(237): a, c, t, g, unknown or other
  modified_base (273)..(273): a, c, t, g, unknown or other
  modified_base (312)..(312): a, c, t, g, unknown or other
  modified_base (317)..(317): a, c, t, g, unknown or other
  modified_base (335)..(335): a, c, t, g, unknown or other
  modified_base (349)..(349): a, c, t, g, unknown or other
ccacactcatcatcgtcattactccyattactatgamgtgaagagttgtgctgctaggacrggagcagcaacttttcaacaccaatcrcttttttagayggcctcctttctagccttgttagttgcccaaattctgaaaaaaaaaacaagaactaagactctagaaggagatccgagaggcagacrnnnnnnnnnnnnnnnnnnnnnnnnnnnnnnnnnnnnnnnnnnnnnnnagangaaggaggaatcaggagtaatgccaagaatgagaanatctgtataagcagttcagaaaaggggcatcatgagtcnctctnctcagtgctgccccaagngttccacagtttgntcc

SEQ ID NO: 4427 - DNA, 664 bp, Artificial Sequence
  Description of Artificial Sequence: Synthetic polynucleotide
  modified_base (1)..(1): a, c, t, g, unknown or other
  modified_base (11)..(11): a, c, t, g, unknown or other
  modified_base (28)..(28): a, c, t, g, unknown or other
  modified_base (74)..(74): a, c, t, g, unknown or other
  modified_base (93)..(93): a, c, t, g, unknown or other
  modified_base (97)..(97): a, c, t, g, unknown or other
  modified_base (132)..(132): a, c, t, g, unknown or other
  modified_base (134)..(134): a, c, t, g, unknown or other
  modified_base (156)..(156): a, c, t, g, unknown or other
  modified_base (162)..(162): a, c, t, g, unknown or other
  modified_base (207)..(207): a, c, t, g, unknown or other
  modified_base (223)..(223): a, c, t, g, unknown or other
  modified_base (227)..(227): a, c, t, g, unknown or other
  modified_base (243)..(243): a, c, t, g, unknown or other
  modified_base (252)..(252): a, c, t, g, unknown or other
  modified_base (283)..(283): a, c, t, g, unknown or other
  modified_base (293)..(293): a, c, t, g, unknown or other
  modified_base (316)..(316): a, c, t, g, unknown or other
  modified_base (335)..(335): a, c, t, g, unknown or other
  modified_base (369)..(369): a, c, t, g, unknown or other
  modified_base (410)..(410): a, c, t, g, unknown or other
  modified_base (416)..(416): a, c, t, g, unknown or other
  modified_base (444)..(444): a, c, t, g, unknown or other
  modified_base (453)..(453): a, c, t, g, unknown or other
  modified_base (500)..(500): a, c, t, g, unknown or other
  modified_base (522)..(522): a, c, t, g, unknown or other
  modified_base (557)..(557): a, c, t, g, unknown or other
  modified_base (577)..(577): a, c, t, g, unknown or other
  modified_base (615)..(615): a, c, t, g, unknown or other
  modified_base (625)..(625): a, c, t, g, unknown or other
  modified_base (660)..(660): a, c, t, g, unknown or other
ncagartgtgncttgatctgactccaanctgatctagaattgaaggctgttaggaagactrttctcacacatanttgtactttgaaaggtggntctnaaattgtctggaggcccatggccaatatcaacagngntttgtgaggaaagagatccccntagtancagtgagcattgtcatgcacagcatgaatgctcaataaatgtacnaaattgaactaaaatntttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgkgatacagaaaaggggtntgtgtncctgagacttctcccttgtctggggagnccrtttctncttccatgttgaatatcstcaccsaaaaagtgagacaaagtttgctntagtccagcaatagacaggatngtaccagragctgaaattatttttatagkaatagnaaagaaatttctgcaataanacttaaaaatatcaattaaaacaaagacaaatatacangatgaaacanaacagcatccaatcaatgggataggagattaaaantcat

SEQ ID NO: 4428 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaaytgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4429 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattkaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4430 - DNA, 693 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  misc_feature (337)..(338): This region may encompass 'gg' or 'ac'
  modified_base (371)..(371): a, c, t, g, unknown or other
  modified_base (405)..(405): a, c, t, g, unknown or other
  modified_base (435)..(435): a, c, t, g, unknown or other
  modified_base (447)..(447): a, c, t, g, unknown or other
  modified_base (454)..(454): a, c, t, g, unknown or other
  modified_base (473)..(473): a, c, t, g, unknown or other
  modified_base (483)..(483): a, c, t, g, unknown or other
  modified_base (492)..(492): a, c, t, g, unknown or other
  modified_base (515)..(515): a, c, t, g, unknown or other
  modified_base (523)..(523): a, c, t, g, unknown or other
  modified_base (530)..(530): a, c, t, g, unknown or other
  modified_base (540)..(540): a, c, t, g, unknown or other
  modified_base (569)..(569): a, c, t, g, unknown or other
  modified_base (585)..(585): a, c, t, g, unknown or other
  modified_base (622)..(622): a, c, t, g, unknown or other
  modified_base (627)..(627): a, c, t, g, unknown or other
  modified_base (633)..(633): a, c, t, g, unknown or other
  modified_base (654)..(654): a, c, t, g, unknown or other
  modified_base (662)..(662): a, c, t, g, unknown or other
  modified_base (665)..(665): a, c, t, g, unknown or other
  modified_base (667)..(667): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctrsaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 4431 - DNA, 198 bp, Artificial Sequence
  Description of Artificial Sequence: Synthetic polynucleotide
  modified_base (21)..(21): a, c, t, g, unknown or other
  modified_base (30)..(30): a, c, t, g, unknown or other
  modified_base (80)..(80): a, c, t, g, unknown or other
  modified_base (139)..(139): a, c, t, g, unknown or other
  modified_base (161)..(161): a, c, t, g, unknown or other
  modified_base (186)..(186): a, c, t, g, unknown or other
tatcaagtactttgtccattngcaggcagntgttaaatacagcagttggctcgtgtggatacagtactgcagagaaaganccrctctgtgaagatttgagcagcatggtcagtgaatgcagagaatgaggcaygatagnacctgtaatctccaaactaaantggtctctgtatccagaaagagctngtgtcttcacat

SEQ ID NO: 4432 - DNA, 374 bp, Artificial Sequence
  Description of Artificial Sequence: Synthetic polynucleotide
  modified_base (16)..(16): a, c, t, g, unknown or other
  modified_base (22)..(22): a, c, t, g, unknown or other
  modified_base (47)..(47): a, c, t, g, unknown or other
  modified_base (72)..(72): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (145)..(145): a, c, t, g, unknown or other
  modified_base (148)..(148): a, c, t, g, unknown or other
  modified_base (153)..(153): a, c, t, g, unknown or other
  modified_base (156)..(156): a, c, t, g, unknown or other
  modified_base (176)..(176): a, c, t, g, unknown or other
  modified_base (193)..(193): a, c, t, g, unknown or other
  modified_base (201)..(201): a, c, t, g, unknown or other
  modified_base (234)..(234): a, c, t, g, unknown or other
  modified_base (309)..(309): a, c, t, g, unknown or other
  modified_base (321)..(321): a, c, t, g, unknown or other
  modified_base (326)..(326): a, c, t, g, unknown or other
  modified_base (334)..(334): a, c, t, g, unknown or other
  modified_base (349)..(349): a, c, t, g, unknown or other
  modified_base (354)..(354): a, c, t, g, unknown or other
  modified_base (363)..(363): a, c, t, g, unknown or other
caaagtttatatcaanaaaagnggtaaatatttaaaaactgagtttntcaagtagtgtctccctttcattcnccttgcagataaactttcaaacyntngaatatttctccacnacctgaagaatcaggatcaagctctcaaaatnccnagtgngtntttctgacaggtcgtagggntgayctcttgaacatgnccaagatnttttggttgctcatcctatcatgatgtcctgwncatctttcagaaatggaacccatattgatggattcaatgtakgcaaaattccactatctaccagatagctgtgcnttcttcattttncaggnagaaacanggttgtagattagantatgntacagcaantattcacctcc

SEQ ID NO: 4433 - DNA, 273 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (87)..(87): a, c, t, g, unknown or other
  modified_base (125)..(125): a, c, t, g, unknown or other
  modified_base (161)..(161): a, c, t, g, unknown or other
  modified_base (166)..(166): a, c, t, g, unknown or other
  modified_base (168)..(168): a, c, t, g, unknown or other
  modified_base (173)..(173): a, c, t, g, unknown or other
gnccattgccaaagttgtggtttttcaatttatgttngagacaaaagagtccaaggagaattccacttgtgtaggttgcataagagngacaaacaaagctgaactggataagagtataaagaaantaagagaagcaaaatgtgtgayagaggccacagatnctgcntntaganagcragatggtgacaaggtgaaaaggggctgcaaatttattaactggctcagtycttmctgagagctctgcaccatatctcctccamacaggtgcagatt

SEQ ID NO: 4434 - DNA, 175 bp, Artificial Sequence
  Description of Artificial Sequence: Synthetic polynucleotide
  modified_base (26)..(26): a, c, t, g, unknown or other
  modified_base (32)..(32): a, c, t, g, unknown or other
  modified_base (84)..(84): a, c, t, g, unknown or other
  modified_base (90)..(90): a, c, t, g, unknown or other
  modified_base (103)..(103): a, c, t, g, unknown or other
  modified_base (146)..(146): a, c, t, g, unknown or other
  modified_base (171)..(171): a, c, t, g, unknown or other
ttctttggcaatggaacattataagntgcagnaccaagaaccayctcgaagagtttgtctgagtaaggtatggttttctctacnctttcncggaaatgggaancccatttggcatatasgatagtgccaccaatacctccaccaanaaacaaaaggccagctccagcaatnttgc

SEQ ID NO: 4435 - DNA, 606 bp, Artificial Sequence
  Description of Artificial Sequence: Synthetic polynucleotide
  modified_base (128)..(128): a, c, t, g, unknown or other
  modified_base (135)..(135): a, c, t, g, unknown or other
  modified_base (222)..(222): a, c, t, g, unknown or other
  modified_base (291)..(291): a, c, t, g, unknown or other
  modified_base (348)..(348): a, c, t, g, unknown or other
  modified_base (404)..(404): a, c, t, g, unknown or other
  modified_base (442)..(442): a, c, t, g, unknown or other
  modified_base (592)..(592): a, c, t, g, unknown or other
cctttacccacttttcctaaacaacccctaaaaaactttgctctgaaaagcagggaatatcactgtgcaaagtaagttgcttttctccacggggctatctgtgtaaaacttgccactgagagctctcnctgytcngctgtgacagcccagcctgcaggtgagcttgcttgcactcccacctgatcagagcacgcctcccygggtcagacactcaatatcctngccctgcaggaggccagagggcccatctgctgctcatggccaggctgggccttggggtgcctgaccccnccagagcaagccccttagatgcccrgcagaatcctctctcccctcctgtaccttggnaggtttccccacactatgcccagtgtcaggctgaarttgggatcatggcacagganmctctggggccctcrgagaatgaggtgcttgatgatgngcagaatctgaacgcagcctggacggaggtttgaggtcatcartggacagacagcttgtcccagcacttagaactcagggcagcagagctgcctagctgggcacaacctgggccaccccacagagggcaggagtgggagaggccaaaggnggtgatcccaggac

SEQ ID NO: 4436 - DNA, 371 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (53)..(53): a, c, t, g, unknown or other
  modified_base (77)..(77): a, c, t, g, unknown or other
  modified_base (80)..(80): a, c, t, g, unknown or other
  modified_base (106)..(106): a, c, t, g, unknown or other
  modified_base (120)..(120): a, c, t, g, unknown or other
  modified_base (123)..(123): a, c, t, g, unknown or other
  modified_base (127)..(127): a, c, t, g, unknown or other
  modified_base (180)..(180): a, c, t, g, unknown or other
  modified_base (188)..(188): a, c, t, g, unknown or other
  modified_base (195)..(195): a, c, t, g, unknown or other
  modified_base (214)..(214): a, c, t, g, unknown or other
  modified_base (238)..(238): a, c, t, g, unknown or other
  modified_base (294)..(294): a, c, t, g, unknown or other
  modified_base (299)..(299): a, c, t, g, unknown or other
  modified_base (305)..(305): a, c, t, g, unknown or other
  modified_base (329)..(329): a, c, t, g, unknown or other
  modified_base (335)..(335): a, c, t, g, unknown or other
  modified_base (347)..(347): a, c, t, g, unknown or other
  modified_base (350)..(350): a, c, t, g, unknown or other
  modified_base (365)..(365): a, c, t, g, unknown or other
ctttattgnattgctttncttatttccataagttttaggctgtaccaacaaanatcaaaaacaatagaaaattacantangaggcaaacattatacacacaatggnataaactagacatnaanctanatttttattyagagcacaagtacacagacaaatatgaagcaaaaacagtgagncgacaaanatgagancatcttagtgtaaaaaatnagtgagyagcaaaataaagatgangagtactcttaacaaaaaattctgttattacaaatattgacaggcagcagattatntgacnaaaagnatcagtcacatatttgacacagtnaacagnaatttccctctnttncaattcacctttctntctttc

SEQ ID NO: 4437 - DNA, 500 bp, Artificial Sequence
  Description of Artificial Sequence: Synthetic polynucleotide
  modified_base (195)..(195): a, c, t, g, unknown or other
  modified_base (280)..(280): a, c, t, g, unknown or other
  modified_base (315)..(315): a, c, t, g, unknown or other
  modified_base (318)..(318): a, c, t, g, unknown or other
  modified_base (443)..(443): a, c, t, g, unknown or other
cagcatcagcatctctccacaagccttcccagagaaaagggctgctcagaccatcccgctgttagtgagctactgtctggtcatgtgctgggtggacctcatcatctcatcttcttcaaccctgctgtggacgtgtaacccagtcttcctgagtatgcagaaccttgtgggcgatgtctaygccactgttgttcnactggaacaaatcagctctgataaaaatatagttgacattctccaaaatatgcaaagtgctataaagctttaacaagttggcganggaaaacatttctaaaaaatagtcttctcctatanttnaattgttcaagtagccctggagttctttttatcttatttaataaaatgcatggaatcatacttttattatatttatatgctttcaaaactgatgcttctaaggaccatgtaatttctttaattcnagtgtctaccatgggttgacatttctgtatcaagtttcttacatttttattttcatt

SEQ ID NO: 4438 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (176)..(176): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgngtaggtgtttggcacccaaaatttcactgaagaagaatgctgtttcttantatcaaaccaaagtgcaaagcaatataaattagaggccaagncttctcttgncgntcnatttacttctgtaaaacagattctatgttccttttctatgancantttacatttgaaacattagattttttcactnatgagggaaggaaangggcttctgtnctacttnaagncngngaagctaaggtctccttctcaaagnagagcyggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 4439 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcrctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4440 - DNA, 149 bp, Artificial Sequence
  Description of Artificial Sequence: Synthetic polynucleotide
  modified_base (19)..(19): a, c, t, g, unknown or other
  modified_base (42)..(42): a, c, t, g, unknown or other
  modified_base (67)..(67): a, c, t, g, unknown or other
  modified_base (73)..(73): a, c, t, g, unknown or other
  modified_base (99)..(99): a, c, t, g, unknown or other
  modified_base (108)..(108): a, c, t, g, unknown or other
  modified_base (116)..(116): a, c, t, g, unknown or other
  modified_base (120)..(120): a, c, t, g, unknown or other
tgaaagaacatggtgttgngaaaagaaagagcagttacacantwgaacagttggaacaggtgtttgntcaggnaggatgggatgctcagccctgccagnctgtacttnttaacagnagtngcttgtaccaggagctggagtcagatggc

SEQ ID NO: 4441 - DNA, 867 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  misc_feature (122)..(123): This region may encompass 'cc' or 'tt'
  modified_base (130)..(130): a, c, t, g, unknown or other
  modified_base (139)..(139): a, c, t, g, unknown or other
  modified_base (163)..(163): a, c, t, g, unknown or other
  modified_base (180)..(180): a, c, t, g, unknown or other
  modified_base (194)..(194): a, c, t, g, unknown or other
  modified_base (262)..(262): a, c, t, g, unknown or other
  modified_base (281)..(281): a, c, t, g, unknown or other
  modified_base (298)..(298): a, c, t, g, unknown or other
  modified_base (327)..(327): a, c, t, g, unknown or other
  modified_base (330)..(330): a, c, t, g, unknown or other
  modified_base (334)..(334): a, c, t, g, unknown or other
  modified_base (357)..(357): a, c, t, g, unknown or other
  modified_base (377)..(377): a, c, t, g, unknown or other
  modified_base (403)..(403): a, c, t, g, unknown or other
  modified_base (417)..(417): a, c, t, g, unknown or other
  modified_base (430)..(430): a, c, t, g, unknown or other
  modified_base (443)..(443): a, c, t, g, unknown or other
  modified_base (462)..(462): a, c, t, g, unknown or other
  modified_base (480)..(480): a, c, t, g, unknown or other
  modified_base (491)..(491): a, c, t, g, unknown or other
  modified_base (505)..(505): a, c, t, g, unknown or other
  modified_base (509)..(509): a, c, t, g, unknown or other
  modified_base (512)..(512): a, c, t, g, unknown or other
  modified_base (584)..(584): a, c, t, g, unknown or other
  modified_base (618)..(618): a, c, t, g, unknown or other
  modified_base (649)..(649): a, c, t, g, unknown or other
  modified_base (674)..(674): a, c, t, g, unknown or other
  modified_base (698)..(698): a, c, t, g, unknown or other
  modified_base (712)..(712): a, c, t, g, unknown or other
  modified_base (717)..(717): a, c, t, g, unknown or other
  modified_base (734)..(734): a, c, t, g, unknown or other
  modified_base (799)..(799): a, c, t, g, unknown or other
  modified_base (801)..(801): a, c, t, g, unknown or other
  modified_base (815)..(815): a, c, t, g, unknown or other
  modified_base (829)..(829): a, c, t, g, unknown or other
  modified_base (838)..(838): a, c, t, g, unknown or other
  modified_base (855)..(855): a, c, t, g, unknown or other
agtctgatgcttcnccttatctgccacttcanaratacacaggagaaangggttaattttgtctgaaancaancacaattagggctaataaataanttanaggtggggtactgtaacatatyycttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactngangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaagnarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 4442 - DNA, 673 bp, Artificial Sequence
  Description of Artificial Sequence: Synthetic polynucleotide
  modified_base (14)..(14): a, c, t, g, unknown or other
  modified_base (78)..(78): a, c, t, g, unknown or other
  modified_base (87)..(87): a, c, t, g, unknown or other
  modified_base (110)..(110): a, c, t, g, unknown or other
  modified_base (134)..(134): a, c, t, g, unknown or other
  modified_base (139)..(139): a, c, t, g, unknown or other
  modified_base (164)..(164): a, c, t, g, unknown or other
  modified_base (180)..(180): a, c, t, g, unknown or other
  modified_base (285)..(285): a, c, t, g, unknown or other
  modified_base (297)..(297): a, c, t, g, unknown or other
  modified_base (360)..(360): a, c, t, g, unknown or other
  modified_base (370)..(370): a, c, t, g, unknown or other
  modified_base (442)..(442): a, c, t, g, unknown or other
  modified_base (498)..(498): a, c, t, g, unknown or other
  modified_base (615)..(615): a, c, t, g, unknown or other
  modified_base (672)..(672): a, c, t, g, unknown or other
cgcgactatgctgnctccttcccatccagcaaagctcctgcttcaggccctcagatggactgaccacagtagcaccgncccatcctnctggacccaggatgcacctgccngagcgcctgagtgccctgagccantgcangggstctcccagggctcaccaggcngcactttccttgyagngctccctgtggattgccatggctgctaggagagcttygyggaggagacgctgacggagaccaactgcaggaacactgtggacttgttgaggaggctygggrctgnccctcggcrccngcatggtgctgggacgcaggaggctcggggctgcccccttggtgcatgmacrgtgctgggacnctgtcagacnctcctgtctttgccccgaagcagaggccaagagaggcacaagggccgcacacctgcctgctcctcttggacncgggtgcccgagcataccctgcaagtgtgcagtctgtcctccaggctgatgcctgnaacacagaccctgtcctgtgccacacccagggctggtctctgaggacctctgtgcagagcyggtgttggccccaggtcccttccctcccagtccaggagctgtagcttgttggcagngggctccatatgcctgagaccaacctgccccctgcacatggatgttgggctgtcacng

SEQ ID NO: 4443 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (239)..(239): a, c, t, g, unknown or other
  modified_base (241)..(241): a, c, t, g, unknown or other
  modified_base (279)..(279): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (389)..(389): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccanccccttcngttctgtggcattgncacaatnaggaatctacttttgtgcttttacacattgaactgacaggtnanrtcaggcatcgactgtcacaggggccagtggagaggtngnagggacgcccacattcgatgaatcctgcatcayggtgttggacttcttgttnttngacactaaacttgttcacattyrataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4444 - DNA, 106 bp, Artificial Sequence
  Description of Artificial Sequence: Synthetic polynucleotide
  modified_base (16)..(16): a, c, t, g, unknown or other
  modified_base (54)..(54): a, c, t, g, unknown or other
  modified_base (86)..(86): a, c, t, g, unknown or other
tcaaacattttcattnttagattgttatccccacttctttaaygagattgagantttcttgagtctctgctcatttattttgtggnttgyttcttttaaaacaaca

SEQ ID NO: 4445 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (351)..(351): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (737)..(737): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagngtccaccccacgcctacaccagccccacatgagctcgggggtctctgggggtcagtgtctgyagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4446 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (870)..(870): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtaycaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacnaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4447 - DNA, 1017 bp, Artificial Sequence
  Description of Artificial Sequence: Synthetic polynucleotide
  modified_base (23)..(23): a, c, t, g, unknown or other
  modified_base (42)..(65): a, c, t, g, unknown or other
  modified_base (116)..(116): a, c, t, g, unknown or other
  modified_base (134)..(134): a, c, t, g, unknown or other
  misc_feature (197)..(201): This region may encompass 'ttgta' or is absent in its entirety
  modified_base (255)..(255): a, c, t, g, unknown or other
  modified_base (270)..(270): a, c, t, g, unknown or other
  modified_base (286)..(286): a, c, t, g, unknown or other
  modified_base (289)..(289): a, c, t, g, unknown or other
  modified_base (296)..(296): a, c, t, g, unknown or other
  modified_base (314)..(314): a, c, t, g, unknown or other
  modified_base (342)..(342): a, c, t, g, unknown or other
  modified_base (360)..(360): a, c, t, g, unknown or other
  modified_base (607)..(607): a, c, t, g, unknown or other
  modified_base (610)..(610): a, c, t, g, unknown or other
  modified_base (658)..(658): a, c, t, g, unknown or other
  modified_base (701)..(701): a, c, t, g, unknown or other
  modified_base (719)..(719): a, c, t, g, unknown or other
  modified_base (767)..(767): a, c, t, g, unknown or other
  modified_base (812)..(812): a, c, t, g, unknown or other
  modified_base (820)..(820): a, c, t, g, unknown or other
  modified_base (833)..(833): a, c, t, g, unknown or other
  modified_base (852)..(852): a, c, t, g, unknown or other
  modified_base (859)..(859): a, c, t, g, unknown or other
  modified_base (920)..(955): a, c, t, g, unknown or other
  modified_base (972)..(972): a, c, t, g, unknown or other
  modified_base (992)..(992): a, c, t, g, unknown or other
gcttctaaataactcataaacantaattactgttgtgacacnnnnnnnnnnnnnnnnnnnnnnnngtatacagaataacatttcagtgctattttggcactcaagggtattaatgnattagaaacacagaaaanaatatttktcttcattgataaagtgtaataaccagcttttacaaaacaggtaattttttatattgtaactcccaaggtatctaaatatgtttagtgcattaacagaacccagaattaactncaaatacaacacctnggtagtctaaatgtcnaanagaaagncacgtaaatgtcgaaagnaaaagtacaatcaatctgttgaaaaatntttataacaactcattancataactaatttctgctaaattgttaaaatctaaaatcgcttattttgataccatatggcaagttttgcagaagccttttrcactaaaaataatcttggcagataaaatataatgagaggtaagtatataataacagaaartaatttaaattgaccagcttctcaatgtctttctcattttagaaacaccaatatgttcycttaatcatatctgcaatgaaaaatattatattagctaaactaytanganaagtactggaatatatctaacatactaatttacaatatcatataaagntatcagtgwataaaagaaggaaaataaaacactacatttaggngaacgcttyaaacccatntgttacaattaaatagctaatgaagagcactcggcattaaaagaaaangtttactatatatacacagtctggaatgtatcttcctaaaccaantaaaaagnacttgtaaaatcntagacaatatcaaagaatngatttcnacagggaacttctcaaatgtcaacactcttatacactacacataaaagaaatcaagcaagnnnnnnnnnnnnnnnnnnnnnnnnnnnnnnnnnnnncataagtaacaattacnaagctaattaacatttgggnaggagggataaagtaaacagctctt

SEQ ID NO: 4448 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactrtagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4449 - DNA, 343 bp, Artificial Sequence
  Description of Artificial Sequence: Synthetic polynucleotide
  modified_base (10)..(39): a, c, t, g, unknown or other
  modified_base (41)..(46): a, c, t, g, unknown or other
  modified_base (52)..(52): a, c, t, g, unknown or other
  modified_base (64)..(64): a, c, t, g, unknown or other
  modified_base (66)..(66): a, c, t, g, unknown or other
  modified_base (79)..(79): a, c, t, g, unknown or other
  modified_base (109)..(109): a, c, t, g, unknown or other
  modified_base (144)..(144): a, c, t, g, unknown or other
  modified_base (172)..(172): a, c, t, g, unknown or other
  modified_base (230)..(230): a, c, t, g, unknown or other
  modified_base (242)..(242): a, c, t, g, unknown or other
  modified_base (252)..(252): a, c, t, g, unknown or other
  modified_base (278)..(278): a, c, t, g, unknown or other
ataatgctgnnnnnnnnnnnnnnnnnnnnnnnnnnnnnnynnnnnngcaaantataaatataananacatatttacttntacttgtgcaaataattctataggcctgantgaaagggaatgttccacctttctacctttttttnaatgacaaatttctgataaaattccttnttacctaatgaatgacttcagtttcaaratatgctaaatgcattcagtttccagtagnctgggcacacantgtatgctanacttggtgaacttgaggactgaaagntttcttggcctgcttgtctggaaagtgcagtggttccttgcagaccttttgtcttcattattttc

SEQ ID NO: 4450 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgastagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4451 - DNA, 159 bp, Artificial Sequence
  Description of Artificial Sequence: Synthetic polynucleotide
  modified_base (21)..(21): a, c, t, g, unknown or other
  modified_base (26)..(26): a, c, t, g, unknown or other
  modified_base (158)..(158): a, c, t, g, unknown or other
cttcacttttaatttctaatntagcntgaagtaagacatacacttaaacaaarccttgttgacatctgtaattatatttatgttgcttttgagtcatcatgaagagagtctaattaaacgtagtgcaaagtaaaaatgcacagtcagaaatgttttcnt

SEQ ID NO: 4452 - DNA, 282 bp, Artificial Sequence
  Description of Artificial Sequence: Synthetic polynucleotide
  modified_base (5)..(5): a, c, t, g, unknown or other
  modified_base (74)..(74): a, c, t, g, unknown or other
  modified_base (82)..(82): a, c, t, g, unknown or other
  modified_base (142)..(142): a, c, t, g, unknown or other
  modified_base (278)..(278): a, c, t, g, unknown or other
  modified_base (282)..(282): a, c, t, g, unknown or other
ttttntgtcttatttagtaatatccttttgttttactctttattaatctaataggggtccatttttattatctnttagatcnatttttttgctacgtttgttttctatttgtatatctttagaaaatattctcataatattngactcacaaaactttataggtaataaaataagtctgacagagagggttaagttctaaaaacatgtataatgggtaagagaacatatgygaatgtatgatgagattgatttagttatcttgcagtgatatgtaaccnaatn

SEQ ID NO: 4453 - DNA, 225 bp, Artificial Sequence
  Description of Artificial Sequence: Synthetic polynucleotide
  modified_base (2)..(2): a, c, t, g, unknown or other
cngaaaccaatgcattttctcttagatcatctcctgcataattgagattaatttttgggcttttggatttcctttgagcttcataaagtggttgatggagcacctcattgttatatattgtattactcacatcaacattcattattccttgcaaakgagcatctcctgcactgtggaaagcaagttcttggttttttcttgatgtgacactttgatcatggtctt

SEQ ID NO: 4454 - DNA, 612 bp, Artificial Sequence
  Description of Artificial Sequence: Synthetic polynucleotide
  modified_base (88)..(88): a, c, t, g, unknown or other
  modified_base (104)..(104): a, c, t, g, unknown or other
  modified_base (173)..(173): a, c, t, g, unknown or other
  modified_base (176)..(176): a, c, t, g, unknown or other
  modified_base (184)..(184): a, c, t, g, unknown or other
  modified_base (215)..(215): a, c, t, g, unknown or other
  modified_base (402)..(402): a, c, t, g, unknown or other
  modified_base (417)..(417): a, c, t, g, unknown or other
  modified_base (488)..(488): a, c, t, g, unknown or other
  modified_base (556)..(556): a, c, t, g, unknown or other
tatctcctccacacaggtgcagattttgcttttagttttacaaagattagagcaaraaagaagctgcttttaaaacaagaaaaaaaancactttcagtgcaccntctcgtataatattatatcctattgtaccctgccrtggtttaggcatcactgtattctctcattgtgtnatntatatatnaagagctaaataaatgtctgtttcattgaangtaagarctaaataaatgtctgtttcattgaatagttcagctctgctttcacctcttctaattaaaccaacaccacatgccacttgctacctcctgaacaattactacttttgtgtttcttcatttatccaacaaacagctccaaagatggaacattcaactctaacataaaccctgctgcttccangggctctgcrcccanccccttgttatgctacactgacatttagacctactagaaggtaactgkttttcatttatgtgtccttacangtcccaataagagtccctgaagaraaaaggtacattgcatacccaacatcaattacatttatcttccntcatatgcaaagcatcgtatgtttccacattcaagaagcaaactcatgagtcatca

SEQ ID NO: 4455 - DNA, 669 bp, Artificial Sequence
  Description of Artificial Sequence: Synthetic polynucleotide
  modified_base (51)..(51): a, c, t, g, unknown or other
  modified_base (112)..(112): a, c, t, g, unknown or other
  modified_base (116)..(162): a, c, t, g, unknown or other
  modified_base (170)..(170): a, c, t, g, unknown or other
  modified_base (229)..(229): a, c, t, g, unknown or other
  modified_base (435)..(435): a, c, t, g, unknown or other
  modified_base (477)..(477): a, c, t, g, unknown or other
  modified_base (537)..(537): a, c, t, g, unknown or other
  modified_base (629)..(658): a, c, t, g, unknown or other
aaaacagtaaatttttatgatagttttaaagttactaagattgagaatatntcaatttttcactgctcatgaatctgtgggttccttaaacaattatacataaggtctatanatannnnnnnnnnnnnnnnnnnnnnnnnnnnnnnnnnnnnnnnnnnnnnnaatggctnagaatcttgcctaacatattgtatgcactaagcaagtactagtaaaattattsatcaanttatcatcttcataccattcttcaaatggcatattgtttgttctaattaaaaactatgtttctgtcttatgttaagtagcaacaaaaattagaaggtctacttgttctgccctcttgagaaaatccaaagttaaatggtagttttactaatttcctttagattcagtaccttattttcctcacacaaaaatgtaaacattaagganaacatcatatttaaatgattcatcctacaatagacagacttngggtcattcattgattgggctgaagtctcactcactctctattatttctaattttttcangttaacagcctagaaaatctactacacatggaatgttataaattagaaattaacaccttggatgtacaaattataaaagtaaactgaaaagnnnnnnnnnnnnnnnnnnnnnnnnnnnnnnggattgttatt

SEQ ID NO: 4456 - DNA, 249 bp, Artificial Sequence
  Description of Artificial Sequence: Synthetic polynucleotide
  modified_base (20)..(20): a, c, t, g, unknown or other
  modified_base (102)..(102): a, c, t, g, unknown or other
tctttcaaaacatgtttacnaaaacatgttttgaaaacattaaatatctttgatatagtttagtaggaaaatactcaaaatcaaaattgtaaaaacaatgtnttcttatacaattaaactgcatttgaagtagatggtaatgtaatacmaatcttgaaaagtttttcttttctaaaacaaggtgccaatgatgtactacactgtaattaacactgaaattctgggaactacttcatcatttccagtcac

SEQ ID NO: 4457 - DNA, 1048 bp, Artificial Sequence
  Description of Artificial Sequence: Synthetic polynucleotide
  modified_base (2)..(2): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcrttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4458 - DNA, 113 bp, Artificial Sequence
  Description of Artificial Sequence: Synthetic polynucleotide
  modified_base (2)..(2): a, c, t, g, unknown or other
  modified_base (22)..(22): a, c, t, g, unknown or other
gnagtaaggagtacaatacagngcataactgttctcaaccttgacaatgtcaatgtyagaaatgacagatgtaagcacataaagggaaaaggaaaggtaaaaagaagagttgc

SEQ ID NO: 4459 - DNA, 151 bp, Artificial Sequence
  Description of Artificial Sequence: Synthetic polynucleotide
  modified_base (26)..(26): a, c, t, g, unknown or other
  modified_base (29)..(29): a, c, t, g, unknown or other
  modified_base (37)..(37): a, c, t, g, unknown or other
  modified_base (42)..(42): a, c, t, g, unknown or other
  modified_base (54)..(54): a, c, t, g, unknown or other
  modified_base (56)..(56): a, c, t, g, unknown or other
  modified_base (69)..(69): a, c, t, g, unknown or other
  modified_base (72)..(72): a, c, t, g, unknown or other
  misc_feature (113)..(114): This region may encompass 'gc' or is absent in its entirety
  modified_base (116)..(116): a, c, t, g, unknown or other
  modified_base (139)..(139): a, c, t, g, unknown or other
tttaacyaataaattaaaactaaaangangggagggnagggnaggggaactaangncaaacttytcatnttntatctggtaagaaattgtgaatttctcagaatttccctgggcanaaaacctgtgaccagagaatctntgaaataaaata

SEQ ID NO: 4460 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcyggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4461 - DNA, 276 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (18)..(18): a, c, t, g, unknown or other
  modified_base (31)..(31): a, c, t, g, unknown or other
  modified_base (53)..(53): a, c, t, g, unknown or other
  modified_base (61)..(61): a, c, t, g, unknown or other
  modified_base (96)..(96): a, c, t, g, unknown or other
  modified_base (119)..(119): a, c, t, g, unknown or other
  modified_base (124)..(124): a, c, t, g, unknown or other
  modified_base (150)..(150): a, c, t, g, unknown or other
  modified_base (153)..(153): a, c, t, g, unknown or other
  modified_base (157)..(157): a, c, t, g, unknown or other
  modified_base (168)..(168): a, c, t, g, unknown or other
  modified_base (179)..(179): a, c, t, g, unknown or other
  modified_base (188)..(188): a, c, t, g, unknown or other
  modified_base (190)..(190): a, c, t, g, unknown or other
  modified_base (199)..(199): a, c, t, g, unknown or other
  modified_base (215)..(215): a, c, t, g, unknown or other
  modified_base (250)..(250): a, c, t, g, unknown or other
  modified_base (252)..(252): a, c, t, g, unknown or other
  modified_base (260)..(260): a, c, t, g, unknown or other
  modified_base (268)..(268): a, c, t, g, unknown or other
ctcaggatncctganacnatttarggtgggnatgtgrgaagctggcttcaggntcagaccngaagacaagtagctgacctgggggttgagccaggnctcmcacctaggcccttctccwnggggntttaccaaaaccagccccatgtcctntangayntgacttttgtnaacacacacanatatcctcncntatgcacangtgtttatgtaaaagnaatgtatgtttatatgccaaggtgacttaaaaatnanaaagtryngtacaaanatgttatt

SEQ ID NO: 4462 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgrccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4463 - DNA, 122 bp, Artificial Sequence
  Description of Artificial Sequence: Synthetic polynucleotide
  modified_base (36)..(36): a, c, t, g, unknown or other
  modified_base (38)..(38): a, c, t, g, unknown or other
  modified_base (61)..(61): a, c, t, g, unknown or other
  modified_base (64)..(64): a, c, t, g, unknown or other
  modified_base (67)..(67): a, c, t, g, unknown or other
  modified_base (89)..(89): a, c, t, g, unknown or other
  modified_base (99)..(99): a, c, t, g, unknown or other
  modified_base (105)..(105): a, c, t, g, unknown or other
  modified_base (118)..(118): a, c, t, g, unknown or other
ctggggacactaaacaaagacaggttcaaaaatacntnmggatgtttctggaacaatrtgnganranagcaaattcacattacaaatanaacaagcacngagaanatgcagcaaaagntaga

SEQ ID NO: 4464 - DNA, 498 bp, Artificial Sequence
  Description of Artificial Sequence: Synthetic polynucleotide
  modified_base (48)..(48): a, c, t, g, unknown or other
  modified_base (125)..(125): a, c, t, g, unknown or other
  modified_base (265)..(308): a, c, t, g, unknown or other
  modified_base (374)..(374): a, c, t, g, unknown or other
  modified_base (403)..(403): a, c, t, g, unknown or other
  modified_base (454)..(454): a, c, t, g, unknown or other
tttttgcctctaaatcttccaggtactgttgtttttgacaatgtaatngatattacttctttctgtgccttcaaaatttcastaaggaaataaactggttaccaaaaacacctgtttgttaaaanttggagtcaaactttttaaagaagagatgtactttgttttctttcctaaatatttaaaaattaataggatttatccatagtataacatggttttaaaaagtaatttaactttagttttattgaatacctatttgtgtagnnnnnnnnnnnnnnnnnnnnnnnnnnnnnnnnnnnnnnnnnnnnggtataaattgtgcattttatatgatatttataccattattttactttgggttctctcatttaaanttataaccaaagttacactgttattcatnttttgtgctatgcatttaatattttcatggattccttttttttctattttnagctagtatatattgcattatatttaaaaccaccacaacaggta

SEQ ID NO: 4465 - DNA, 2631 bp, Artificial Sequence
  Description of Artificial Sequence: Synthetic polynucleotide
  modified_base (248)..(291): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggmcttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4466 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttstagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4467 - DNA, 246 bp, Artificial Sequence
  Description of Artificial Sequence: Synthetic polynucleotide
  modified_base (5)..(5): a, c, t, g, unknown or other
  modified_base (14)..(14): a, c, t, g, unknown or other
  modified_base (63)..(63): a, c, t, g, unknown or other
  modified_base (72)..(72): a, c, t, g, unknown or other
  modified_base (86)..(86): a, c, t, g, unknown or other
  modified_base (106)..(106): a, c, t, g, unknown or other
  modified_base (112)..(112): a, c, t, g, unknown or other
  modified_base (141)..(141): a, c, t, g, unknown or other
  modified_base (146)..(146): a, c, t, g, unknown or other
  modified_base (148)..(148): a, c, t, g, unknown or other
  modified_base (171)..(171): a, c, t, g, unknown or other
  modified_base (201)..(201): a, c, t, g, unknown or other
  modified_base (215)..(215): a, c, t, g, unknown or other
  modified_base (224)..(224): a, c, t, g, unknown or other
  modified_base (229)..(229): a, c, t, g, unknown or other
  modified_base (233)..(233): a, c, t, g, unknown or other
atcrngcagaatantgtacagattttggaatcggtacagttgaaatgggaactttttcagagntggacaganttttcaaggctccntctttctaataaactggccntttttnggaattggttataacacccgttggaaagnggatntncrttaccattatgctgagatcanctcccaggtgccccttggcaagcgacttcnggagtacttcaacnctgagaagnctgangganggatcattatgac

SEQ ID NO: 4468 - DNA, 1942 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  misc_feature (1388)..(1389): This region may encompass 'gc' or 'ag'
  modified_base (1411)..(1411): a, c, t, g, unknown or other
  modified_base (1416)..(1416): a, c, t, g, unknown or other
  modified_base (1419)..(1419): a, c, t, g, unknown or other
  modified_base (1480)..(1480): a, c, t, g, unknown or other
  modified_base (1496)..(1496): a, c, t, g, unknown or other
  modified_base (1502)..(1502): a, c, t, g, unknown or other
  modified_base (1512)..(1512): a, c, t, g, unknown or other
  modified_base (1536)..(1536): a, c, t, g, unknown or other
  modified_base (1569)..(1569): a, c, t, g, unknown or other
  modified_base (1620)..(1620): a, c, t, g, unknown or other
  modified_base (1626)..(1626): a, c, t, g, unknown or other
  modified_base (1672)..(1672): a, c, t, g, unknown or other
  modified_base (1674)..(1674): a, c, t, g, unknown or other
  modified_base (1689)..(1689): a, c, t, g, unknown or other
  modified_base (1750)..(1750): a, c, t, g, unknown or other
  modified_base (1867)..(1867): a, c, t, g, unknown or other
  modified_base (1909)..(1909): a, c, t, g, unknown or other
  modified_base (1941)..(1941): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttrsgaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4469 - DNA, 173 bp, Artificial Sequence
  Description of Artificial Sequence: Synthetic polynucleotide
  modified_base (12)..(12): a, c, t, g, unknown or other
  modified_base (23)..(23): a, c, t, g, unknown or other
  modified_base (33)..(33): a, c, t, g, unknown or other
  modified_base (68)..(68): a, c, t, g, unknown or other
  modified_base (71)..(71): a, c, t, g, unknown or other
  modified_base (103)..(103): a, c, t, g, unknown or other
  modified_base (105)..(105): a, c, t, g, unknown or other
  modified_base (112)..(112): a, c, t, g, unknown or other
  modified_base (130)..(130): a, c, t, g, unknown or other
  modified_base (162)..(162): a, c, t, g, unknown or other
  modified_base (166)..(166): a, c, t, g, unknown or other
cctcatgagagnggaatttggtncatccagttnacgcagggcatattccatgtcttcttttctgaganacncraccatccccactccatccttctgcacatcngntaacagncatccccagcttctcgcntgtgatccttcaggtcctgccagctgcctgankgangaagtcc

SEQ ID NO: 4470 - DNA, 374 bp, Artificial Sequence
  Description of Artificial Sequence: Synthetic polynucleotide
  modified_base (16)..(16): a, c, t, g, unknown or other
  modified_base (22)..(22): a, c, t, g, unknown or other
  modified_base (47)..(47): a, c, t, g, unknown or other
  modified_base (72)..(72): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (148)..(148): a, c, t, g, unknown or other
  modified_base (153)..(153): a, c, t, g, unknown or other
  modified_base (156)..(156): a, c, t, g, unknown or other
  modified_base (176)..(176): a, c, t, g, unknown or other
  modified_base (193)..(193): a, c, t, g, unknown or other
  modified_base (201)..(201): a, c, t, g, unknown or other
  modified_base (234)..(234): a, c, t, g, unknown or other
  modified_base (276)..(276): a, c, t, g, unknown or other
  modified_base (309)..(309): a, c, t, g, unknown or other
  modified_base (321)..(321): a, c, t, g, unknown or other
  modified_base (326)..(326): a, c, t, g, unknown or other
  modified_base (334)..(334): a, c, t, g, unknown or other
  modified_base (349)..(349): a, c, t, g, unknown or other
  modified_base (354)..(354): a, c, t, g, unknown or other
  modified_base (363)..(363): a, c, t, g, unknown or other
caaagtttatatcaanaaaagnggtaaatatttaaaaactgagtttntcaagtagtgtctccctttcattcnccttgcagataaactttcaaacyntngaatatttctccacnacctgaagaatcaggatcaagctctcaaaatyccnagtgngtntttctgacaggtcgtagggntgayctcttgaacatgnccaagatnttttggttgctcatcctatcatgatgtcctgwncatctttcagaaatggaacccatattgatggattcaatgtangcaaaattccactatctaccagatagctgtgcnttcttcattttncaggnagaaacanggttgtagattagantatgntacagcaantattcacctcc

SEQ ID NO: 4471 - DNA, 869 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (261)..(261): a, c, t, g, unknown or other
  modified_base (280)..(280): a, c, t, g, unknown or other
  modified_base (297)..(297): a, c, t, g, unknown or other
  modified_base (326)..(326): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  modified_base (376)..(376): a, c, t, g, unknown or other
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  modified_base (583)..(583): a, c, t, g, unknown or other
  misc_feature (617)..(620): This region may encompass 'gaag' or is absent in its entirety
  modified_base (651)..(651): a, c, t, g, unknown or other
  modified_base (676)..(676): a, c, t, g, unknown or other
  modified_base (700)..(700): a, c, t, g, unknown or other
  modified_base (714)..(714): a, c, t, g, unknown or other
  modified_base (719)..(719): a, c, t, g, unknown or other
  modified_base (736)..(736): a, c, t, g, unknown or other
  modified_base (801)..(801): a, c, t, g, unknown or other
  modified_base (803)..(803): a, c, t, g, unknown or other
  modified_base (817)..(817): a, c, t, g, unknown or other
  modified_base (831)..(831): a, c, t, g, unknown or other
  modified_base (840)..(840): a, c, t, g, unknown or other
  modified_base (857)..(857): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactngangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaaggaagarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 4472 - DNA, 667 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (60)..(60): a, c, t, g, unknown or other
  modified_base (85)..(85): a, c, t, g, unknown or other
  modified_base (110)..(110): a, c, t, g, unknown or other
  modified_base (124)..(124): a, c, t, g, unknown or other
  modified_base (157)..(157): a, c, t, g, unknown or other
  modified_base (185)..(185): a, c, t, g, unknown or other
  modified_base (204)..(204): a, c, t, g, unknown or other
  modified_base (209)..(209): a, c, t, g, unknown or other
  modified_base (219)..(219): a, c, t, g, unknown or other
  modified_base (261)..(261): a, c, t, g, unknown or other
  modified_base (270)..(270): a, c, t, g, unknown or other
  modified_base (297)..(297): a, c, t, g, unknown or other
  modified_base (315)..(315): a, c, t, g, unknown or other
  modified_base (320)..(320): a, c, t, g, unknown or other
  modified_base (324)..(324): a, c, t, g, unknown or other
  modified_base (355)..(355): a, c, t, g, unknown or other
  modified_base (383)..(383): a, c, t, g, unknown or other
  modified_base (395)..(395): a, c, t, g, unknown or other
  modified_base (411)..(411): a, c, t, g, unknown or other
  modified_base (432)..(432): a, c, t, g, unknown or other
  modified_base (452)..(452): a, c, t, g, unknown or other
  modified_base (470)..(470): a, c, t, g, unknown or other
  modified_base (475)..(475): a, c, t, g, unknown or other
  modified_base (487)..(487): a, c, t, g, unknown or other
  modified_base (517)..(517): a, c, t, g, unknown or other
  modified_base (532)..(532): a, c, t, g, unknown or other
  modified_base (546)..(546): a, c, t, g, unknown or other
  modified_base (578)..(578): a, c, t, g, unknown or other
  modified_base (613)..(613): a, c, t, g, unknown or other
  modified_base (653)..(653): a, c, t, g, unknown or other
  modified_base (656)..(656): a, c, t, g, unknown or other
cccctcagcatggncctctgaaccagcctgacctgncctgcaggctccaacacaccagcnggccctgccagaaccttggcaaggncrggatgcatgaattccagagccangacagcccgtcaanagggccttmttatttccccttcccagggccacnactgcacagaataatgatttttgacagngaagccaaatgaatactangggangtgaccactngtactcaggagtacttatgagaaaaagaataagaacaaaaantgtttaagntacctctctattgtataatatatactnacaacaaataaaacattntgttnaacnttagaaattacattttaaaacaagattctcnttaaaaacacacacaaaccacacacacnaatgacaacaanaataaaaacactgtangaatactgcaggaagggttcnaggtaatccacatcaacccnggtatcaggttcttgagnccagnccatggctaagngcgaacacactctgtattagtgtctcaagncagggggccctgacnccagcaactttgangttaaactgttatgtacattatatctacatgngaatacagtattttaaattaggaggcaagcacacntataaaggtgttactctaccaaatatcaggagatggttgnggncagagaacagt

SEQ ID NO: 4473 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (83)..(83): a, c, t, g, unknown or other
  modified_base (119)..(119): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (271)..(271): a, c, t, g, unknown or other
  modified_base (328)..(328): a, c, t, g, unknown or other
  modified_base (344)..(344): a, c, t, g, unknown or other
  modified_base (390)..(390): a, c, t, g, unknown or other
  modified_base (405)..(405): a, c, t, g, unknown or other
  modified_base (412)..(412): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
  modified_base (489)..(489): a, c, t, g, unknown or other
ctccactgtgtgcagtggaatcctgggaaatttaagagctactctctntangcngagactttgnaggcccattcagaganctnaataaaacaacatggttgcaggtaatggcaacaagntntagctnaaatcacccangacatttagatrtgtattccaggctgttagtttaatgtttgctgtatgtacnatgtagtcntttctgttaattatntttcttaactaatttttagaaagagtactctanttgangttcanaactgataggganaaaggtgggaatgggaatgggaaactgtacaaatatttaatgactctaaatatttgngagaactgaggaaatnwcacatggattatggtgctaaaaaggactgttatctaaytgagttntttgtcctgatccanttcctgntccttatcttattgtactattccatcttctgccacttaaattcacagaaacaaaatgcaagnaaangntntcttncntgccttcccagactgatttaataaaaatggc

SEQ ID NO: 4474 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtyttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4475 - DNA, 370 bp, Artificial Sequence
  Description of Artificial Sequence: Synthetic polynucleotide
  modified_base (24)..(24): a, c, t, g, unknown or other
  modified_base (30)..(30): a, c, t, g, unknown or other
  modified_base (103)..(103): a, c, t, g, unknown or other
  modified_base (131)..(131): a, c, t, g, unknown or other
  modified_base (175)..(175): a, c, t, g, unknown or other
  modified_base (199)..(199): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (351)..(351): a, c, t, g, unknown or other
taaaagagggaagatgacttttcntaaagngtggaataaagaaaagtaagatagcggatagaagcttgaagtgaaagcaggttcacaggaagtttctttggtntttgttttgtttttaaatagtggaaagntgtrtatgtttatggagaaagattgccttgaagatgcaagaggnagagatgatcaaaattcaagaagnagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 4476 - DNA, 274 bp, Artificial Sequence
  Description of Artificial Sequence: Synthetic polynucleotide
  modified_base (30)..(30): a, c, t, g, unknown or other
  modified_base (53)..(53): a, c, t, g, unknown or other
  modified_base (67)..(67): a, c, t, g, unknown or other
  modified_base (71)..(71): a, c, t, g, unknown or other
  modified_base (82)..(82): a, c, t, g, unknown or other
  modified_base (90)..(90): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (127)..(127): a, c, t, g, unknown or other
  modified_base (137)..(137): a, c, t, g, unknown or other
  modified_base (139)..(139): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (156)..(156): a, c, t, g, unknown or other
  modified_base (180)..(180): a, c, t, g, unknown or other
  modified_base (228)..(228): a, c, t, g, unknown or other
  modified_base (232)..(232): a, c, t, g, unknown or other
  modified_base (235)..(235): a, c, t, g, unknown or other
  modified_base (241)..(241): a, c, t, g, unknown or other
  modified_base (247)..(247): a, c, t, g, unknown or other
ctgcctggttctcccgcctctgcaagcctngccttcaggactccgcctcgccncctcttttctgttnggangactcacgggnccgtctgnctgganangtgtgcacatttctnaccacgattcctcngcacaccagntncaggnacngcngcsstngggacggcacagctgaactgtgcnggcagcgaaggggcctcacggggacsgctcagctccctgagggcgcancccnccntggtcngggggnggaataaacttccgcggttttcagtga

SEQ ID NO: 4477 - DNA, 518 bp, Artificial Sequence
  Description of Artificial Sequence: Synthetic polynucleotide
  misc_feature (83)..(84): This region may encompass 'cg' or 'ga'
  modified_base (134)..(134): a, c, t, g, unknown or other
  modified_base (227)..(227): a, c, t, g, unknown or other
  modified_base (267)..(267): a, c, t, g, unknown or other
  modified_base (316)..(316): a, c, t, g, unknown or other
  modified_base (345)..(345): a, c, t, g, unknown or other
  modified_base (405)..(405): a, c, t, g, unknown or other
  modified_base (409)..(409): a, c, t, g, unknown or other
  modified_base (415)..(415): a, c, t, g, unknown or other
  modified_base (427)..(427): a, c, t, g, unknown or other
  modified_base (462)..(462): a, c, t, g, unknown or other
  modified_base (484)..(484): a, c, t, g, unknown or other
  modified_base (491)..(491): a, c, t, g, unknown or other
tttttccaccaccccaatgctacctctataactcacacatgatagttttataaagataactacctggcattcaggttaaaatsrcaacwgcacccagaatagraaaaactataaattatgcattggactctgcnatcaccagcccctacttgtaaatttcaatggagattcactttayttcaaaattagaaaactgatctcagagtttaaaacctcatttacagctncaaaatatttagaatctagaattatataacaaatacttantttcttagcatgcaaaaattatttacaaatcatttaaaaaggatgatcnacttaacagaaaaatgggcaatgacaaanagactattagttacctaaccaatagccactccccactcacaacctgttccttacagagtncacntcccantatcatggctgnaaggaacatcyttgctctctcaccctcacttgtanctaggacatggatggataccantcacggntgatgggatttaagaaaaaaatctgtt

SEQ ID NO: 4478 - DNA, 150 bp, Artificial Sequence
  Description of Artificial Sequence: Synthetic polynucleotide
  modified_base (69)..(69): a, c, t, g, unknown or other
tgtgacaaattctatggcatctttcmctcctaatctttttttaaatgcttttgtttggtatttgataanaatgtgtctatggttacttttcaactgtgcaacacatttatctccatgccgagtcaaactttctaatgaagttaatagttt

SEQ ID NO: 4479 - DNA, 196 bp, Artificial Sequence
  Description of Artificial Sequence: Synthetic polynucleotide
gatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcrgggagaaattctctggagtcatctggaacttctccgaaaat

SEQ ID NO: 4480 - DNA, 374 bp, Artificial Sequence
  Description of Artificial Sequence: Synthetic polynucleotide
  modified_base (3)..(3): a, c, t, g, unknown or other
  modified_base (15)..(15): a, c, t, g, unknown or other
  modified_base (25)..(25): a, c, t, g, unknown or other
  modified_base (40)..(40): a, c, t, g, unknown or other
  modified_base (61)..(61): a, c, t, g, unknown or other
  modified_base (80)..(80): a, c, t, g, unknown or other
  modified_base (91)..(91): a, c, t, g, unknown or other
  modified_base (99)..(99): a, c, t, g, unknown or other
  modified_base (113)..(113): a, c, t, g, unknown or other
  modified_base (136)..(136): a, c, t, g, unknown or other
  modified_base (142)..(142): a, c, t, g, unknown or other
  modified_base (147)..(147): a, c, t, g, unknown or other
  modified_base (158)..(158): a, c, t, g, unknown or other
  modified_base (217)..(217): a, c, t, g, unknown or other
  modified_base (254)..(254): a, c, t, g, unknown or other
  modified_base (272)..(272): a, c, t, g, unknown or other
  modified_base (274)..(274): a, c, t, g, unknown or other
  modified_base (295)..(295): a, c, t, g, unknown or other
  modified_base (299)..(299): a, c, t, g, unknown or other
  modified_base (301)..(301): a, c, t, g, unknown or other
  modified_base (310)..(310): a, c, t, g, unknown or other
  modified_base (322)..(322): a, c, t, g, unknown or other
  modified_base (336)..(336): a, c, t, g, unknown or other
  modified_base (352)..(352): a, c, t, g, unknown or other
  modified_base (370)..(370): a, c, t, g, unknown or other
cantcctgaggagcnctttaaaaantcattcaaggaaatnaaaaaaaaaagtctctttaangataaatgcaaattacagncatagttgganmctaaaantatgtcttgaatangaaaattaccagaggatgaattncttaanagcangactgtctttnaagagtttctaatatatttaatctccagtaaactctaggatatccaaaggtgtrgtacntttttttttccagaatatgcagtgtctgagaaacttntatcacatctatccatgnantcaactaatgtcagcaaaacnagangnaaatcatanataaagggaagnatgaaaatattttnttgtaaacttctgagncatagggataaggaaagnaagt

SEQ ID NO: 4481 - DNA, 153 bp, Artificial Sequence
  Description of Artificial Sequence: Synthetic polynucleotide
  modified_base (40)..(40): a, c, t, g, unknown or other
  modified_base (67)..(67): a, c, t, g, unknown or other
  modified_base (72)..(72): a, c, t, g, unknown or other
  modified_base (82)..(82): a, c, t, g, unknown or other
  misc_feature (115)..(118): This region may encompass 'attt' or is absent in its entirety
ggcttccacatataagcaattcaatttcttctggtctgantaagtactttaagggagattcattggncaccntatgaaaacntctccgaaaagccttgaactgtttttctactgatttattgagaatgtagtcagaataaagattgacaaatt

SEQ ID NO: 4482 - DNA, 316 bp, Artificial Sequence
  Description of Artificial Sequence: Synthetic polynucleotide
  modified_base (10)..(10): a, c, t, g, unknown or other
  modified_base (20)..(20): a, c, t, g, unknown or other
  modified_base (22)..(22): a, c, t, g, unknown or other
  modified_base (29)..(29): a, c, t, g, unknown or other
  modified_base (35)..(35): a, c, t, g, unknown or other
  modified_base (37)..(37): a, c, t, g, unknown or other
  modified_base (63)..(63): a, c, t, g, unknown or other
  modified_base (68)..(68): a, c, t, g, unknown or other
  modified_base (130)..(130): a, c, t, g, unknown or other
  modified_base (134)..(134): a, c, t, g, unknown or other
  modified_base (138)..(138): a, c, t, g, unknown or other
  modified_base (159)..(159): a, c, t, g, unknown or other
  modified_base (164)..(164): a, c, t, g, unknown or other
  modified_base (178)..(178): a, c, t, g, unknown or other
  modified_base (187)..(187): a, c, t, g, unknown or other
  modified_base (190)..(190): a, c, t, g, unknown or other
  modified_base (240)..(240): a, c, t, g, unknown or other
  modified_base (245)..(245): a, c, t, g, unknown or other
  modified_base (262)..(262): a, c, t, g, unknown or other
  modified_base (274)..(274): a, c, t, g, unknown or other
  modified_base (286)..(286): a, c, t, g, unknown or other
  modified_base (312)..(312): a, c, t, g, unknown or other
ctggactaanatgtgtgtyngnttttttntttgtntnttttcactcagaatgattccttccwnggggnttctgagtctcctccctaccccattgtctagccctttaaatacatttgacaatraagttctntctnttcnccagacatatttggacatgtngaatnccagcaagagaagnagtttgttnttncccctgaaggcttccagctgtgtgcaagcagacttccacagatgccayancatcncttagcagatgtgttcngatatttctaantccacctaattnaagctgaaaattctcaattgtgttanaaaa

SEQ ID NO: 4483 - DNA, 1999 bp, Artificial Sequence
  Description of Artificial Sequence: Synthetic polynucleotide
  modified_base (8)..(8): a, c, t, g, unknown or other
  modified_base (118)..(118): a, c, t, g, unknown or other
  modified_base (381)..(381): a, c, t, g, unknown or other
  modified_base (412)..(468): a, c, t, g, unknown or other
  modified_base (617)..(617): a, c, t, g, unknown or other
  modified_base (1246)..(1246): a, c, t, g, unknown or other
  modified_base (1265)..(1265): a, c, t, g, unknown or other
  modified_base (1335)..(1335): a, c, t, g, unknown or other
  misc_feature (1386)..(1389): This region may encompass 'aaca' or is absent in its entirety
  modified_base (1536)..(1536): a, c, t, g, unknown or other
  modified_base (1710)..(1710): a, c, t, g, unknown or other
  modified_base (1712)..(1712): a, c, t, g, unknown or other
  modified_base (1753)..(1753): a, c, t, g, unknown or other
  modified_base (1887)..(1887): a, c, t, g, unknown or other
  modified_base (1977)..(1977): a, c, t, g, unknown or other
ataagccnctgtttataagcatggctcactcttactggctgaagagattgayttctcttgcctgccgctcttcatagcctccataaggaatgtttcaggatgtgattatgctgggganttagacacacataagggragacttttgcagagycctgccatagcatcaaaaaacaagatataacaaaaccaggaggcacmgggactagaatgcaggaggctcatcaccttttgtttcccrgyccagttcccacccaggagtactcaaaactctgcccagattcaaaatgcaaaattaaacagaccatatattaacagttgtatatatattttgcacatgaagaaaatcattatagtattacaattgtgtgtgtatatatatangycataatttttcaaatgcttggaaatgacnnnnnnnnnnnnnnnnnnnnnnnnnnnnnnnnnnnnnnnnnnnnnnnnnnnnnnnnnctatgataggggatgtggcatcttgaaggcctagttgggctgcgtgtgccattaaratatacmgggctgcagaaaagtaaaccccaaatagaatattcctttatcccttgaatgttggaaggataattagatcagatatgatcacgttnaattgatcagattggagccagtgctaactcaatcaacttccaattcctaaggcagcagaaagcccagctggagagggaaasttctgctctatctcaccctccctcattcatcctgggagccacaytgtgttctgtagaatttgctcaggattcacaatctgagctgataaacttacctggattatcryaacccttaccattttggtattttctttttgtttctcagtttaaaatgggttgtgaatattactaaygcatcataagttttcagacacccagtatgtcacttgtytgggtccmgtcctaggaaatcaatacctaaattcaaaaartcatcctaagattaatctttgaaagctgcctgtgatgattyggactcactgacctcccttctcttcaacctacagagaaagygaaagagctaccaagtctkagggcacatggacagaaccagaagatgcccagtgaagtgctaggatagggtacagtcccatagctttygggccaaatgagaaggaaaagcagaacctgggaccaggaaagccccagcagctccagactccaggrctctttaccaagactgatgggaggaactaaggcaaagatgagacacctgtcaccaagacacntgtcttggctgcttccacntctgactcagttgtgttgktgtgaatgcaaaactggctctctggctcccaagaatgtataaatccagganagaaaaccaagcatttgggcaccaggcaagaggtctttccagattccccaaacagacttttcagaattccccaaagatactgaaactcagacccattctgaccccaccccaaaaagtatcataaatggaatctgggagccattcagagtctccagcctcctctttggtgaaaatggacttggacctaaaaaggcaccccantgtccacaaggacacaaattcagatgctgagcactggcctcctgccttccgatgacggatcttacctgagtcccatcaaagcccatactgttccccaayctccaccatccagacattaggaacaatccctcagaactgtcttgatgagatgggacaagcagtggtagargtccngnttcagaatggttgcctcatctttcccttctgagaagtctanaccygctggtctgagccttcatcccttacatggcttagcccatgtcccaggaagtgccccctaaaagaaccttctagtatttttctcccctgaagagagggtccatgagacactctatgccaggaaatacatgncctccattctcacatgacttgattgactgataaactgataccctgagaaagaaaaagatgcagggaacatcttgtgtgtggtgaatctgngctcctcagctgtggtgcctgt

SEQ ID NO: 4484 - DNA, 442 bp, Artificial Sequence
  Description of Artificial Sequence: Synthetic polynucleotide
  modified_base (10)..(10): a, c, t, g, unknown or other
  modified_base (49)..(49): a, c, t, g, unknown or other
  modified_base (52)..(52): a, c, t, g, unknown or other
  modified_base (75)..(75): a, c, t, g, unknown or other
  modified_base (79)..(79): a, c, t, g, unknown or other
  modified_base (102)..(102): a, c, t, g, unknown or other
  modified_base (134)..(134): a, c, t, g, unknown or other
  modified_base (152)..(152): a, c, t, g, unknown or other
  modified_base (167)..(167): a, c, t, g, unknown or other
  modified_base (182)..(182): a, c, t, g, unknown or other
  modified_base (189)..(189): a, c, t, g, unknown or other
  modified_base (199)..(199): a, c, t, g, unknown or other
  modified_base (237)..(237): a, c, t, g, unknown or other
  modified_base (262)..(262): a, c, t, g, unknown or other
  modified_base (270)..(270): a, c, t, g, unknown or other
  modified_base (279)..(279): a, c, t, g, unknown or other
  modified_base (298)..(298): a, c, t, g, unknown or other
  modified_base (306)..(306): a, c, t, g, unknown or other
  modified_base (348)..(348): a, c, t, g, unknown or other
  modified_base (392)..(392): a, c, t, g, unknown or other
  modified_base (405)..(405): a, c, t, g, unknown or other
  modified_base (419)..(419): a, c, t, g, unknown or other
  modified_base (426)..(426): a, c, t, g, unknown or other
ttgtcagagntcagggtacaagcagctgtctgactccaaaccctttatngangctgcctggctttttctctagcncttnacttcttaattagtgcagagaancaagtcttgcctttcatttcttcccctgcacngaagaaaaatctaaaagncatccttttgtaacntgaaaacttggaatnaaaaatncattaaaatnttatctatagaaacactcccaaagcytcatagcaaganattcagataaaagcacatattttcnctactttnatgtgcatnagtttaaastccatgactnttattttnatcttcatcattccctatttgactgatttttaacctatcatnttacaccatggagtggcaaatactatcaaggaatcaaaaaaagncaactccttcaanaatctaatttatangaaatanagtaaattacaatgat

SEQ ID NO: 4485 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacrtcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4486 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagmagcccgtgtgcaaaggaggtgaaggatng

SEQ ID NO: 4487 - DNA, 320 bp, Artificial Sequence
  Description of Artificial Sequence: Synthetic polynucleotide
  modified_base (12)..(12): a, c, t, g, unknown or other
  modified_base (68)..(68): a, c, t, g, unknown or other
  modified_base (73)..(73): a, c, t, g, unknown or other
  modified_base (87)..(87): a, c, t, g, unknown or other
  modified_base (117)..(117): a, c, t, g, unknown or other
  modified_base (122)..(122): a, c, t, g, unknown or other
  modified_base (124)..(124): a, c, t, g, unknown or other
  modified_base (137)..(137): a, c, t, g, unknown or other
  modified_base (140)..(140): a, c, t, g, unknown or other
  modified_base (168)..(168): a, c, t, g, unknown or other
  modified_base (203)..(203): a, c, t, g, unknown or other
  modified_base (211)..(211): a, c, t, g, unknown or other
  modified_base (221)..(221): a, c, t, g, unknown or other
  modified_base (267)..(267): a, c, t, g, unknown or other
  modified_base (286)..(286): a, c, t, g, unknown or other
  modified_base (293)..(293): a, c, t, g, unknown or other
  modified_base (303)..(303): a, c, t, g, unknown or other
  modified_base (314)..(314): a, c, t, g, unknown or other
cttctgtccttntttatggtaaaagtagggaactctgcttatgcacatcaacggaatcattattayancaganccttggactggggnattttgtaccccattggctcacctttcrtnttacnanagaaggctttctnacngagttttygtcacactccttccccgccngttgcccctcgttgtgcctgaagattmgctcwtgncgcctgangaagaaagtngtctgccttacgaccaaaagcctgtggcaaattttgagtrctttcnatcagggccgttgcctggntgcatgnactcaccccnaaagtccctcntttatc

SEQ ID NO: 4488 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnasgaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4489 - DNA, 324 bp, Artificial Sequence
  Description of Artificial Sequence: Synthetic polynucleotide
  modified_base (97)..(97): a, c, t, g, unknown or other
  modified_base (174)..(174): a, c, t, g, unknown or other
  modified_base (227)..(227): a, c, t, g, unknown or other
  modified_base (268)..(268): a, c, t, g, unknown or other
  modified_base (270)..(270): a, c, t, g, unknown or other
  modified_base (287)..(287): a, c, t, g, unknown or other
aattatttctttttgttgataagaatatgatattttgttggtaagaataggacatatggccttgcttagaagaaaggtgactaagaattgtagttcngaaggggagctattttccagtaacagctctacactctagaagaagatataagaaaattgatgaatacttagttcccngtaatttactctgtctcctataatctgagmttttaatttctccagtgcagtgnttatctgattatcctttgtagataatttcctttgtaagtananttctgtactagggagancttcacttttcttctttgtctactaacatacttcagg

SEQ ID NO: 4490 - DNA, 150 bp, Artificial Sequence
  Description of Artificial Sequence: Synthetic polynucleotide
  modified_base (83)..(83): a, c, t, g, unknown or other
  modified_base (131)..(131): a, c, t, g, unknown or other
acatgtgtggcagaggcgggcccagccatggcccctcctccctataccggtacaargtgaggaagctctggatggtcctcccngcaccccaggaccatagggtgaggggtctcctgggttgggccccattngcccctagcraggtcaggc

SEQ ID NO: 4491 - DNA, 175 bp, Artificial Sequence
  Description of Artificial Sequence: Synthetic polynucleotide
  modified_base (9)..(9): a, c, t, g, unknown or other
  modified_base (20)..(20): a, c, t, g, unknown or other
  modified_base (44)..(44): a, c, t, g, unknown or other
  modified_base (56)..(56): a, c, t, g, unknown or other
  modified_base (76)..(76): a, c, t, g, unknown or other
  modified_base (102)..(102): a, c, t, g, unknown or other
  modified_base (135)..(135): a, c, t, g, unknown or other
  modified_base (142)..(142): a, c, t, g, unknown or other
  modified_base (154)..(154): a, c, t, g, unknown or other
  modified_base (160)..(160): a, c, t, g, unknown or other
ttgagaagntaccattgtcngcyatgcttttaaagacatcaggnccattcttgctncttctgatgaaaccaaatcngattaaaaaccaaaataccacttctntatrcaagggtctaactattttggactgaaagnaaaaatngtaattggatgnccagtnartgaccaattaatg

SEQ ID NO: 4492 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacrggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4493 - DNA, 400 bp, Artificial Sequence
  Description of Artificial Sequence: Synthetic polynucleotide
  modified_base (88)..(88): a, c, t, g, unknown or other
  modified_base (90)..(90): a, c, t, g, unknown or other
  modified_base (205)..(205): a, c, t, g, unknown or other
  modified_base (215)..(215): a, c, t, g, unknown or other
attgacacggaaaggcaaaaagactttctggattatgaaaaaacatgatatccaacaaatcttgattgcccatgtaaatcttgattgncnatgtaatgtttagtttgtattctttaagccatgtcataagtatatctcytcattgtagtcacacagtttgtcatatcattcttgaaatacttccttctcattygagtcatattcntcaacataantccagggtttactccagtttttccacagtatggttgcctagcaaagcgactataccatcttatttgaggttccttgtgttctgaggccactggagcaatttatgtggaattaaatttctttagtaaagaacaaatatgatcaactggtcgtaaaaaaggctattagtgtgggagtmaacttcttt

SEQ ID NO: 4494 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcrtaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaanaccttttatggctcagtgctcattc

SEQ ID NO: 4495 - DNA, 336 bp, Artificial Sequence
  Description of Artificial Sequence: Synthetic polynucleotide
  modified_base (17)..(17): a, c, t, g, unknown or other
  modified_base (19)..(19): a, c, t, g, unknown or other
  modified_base (69)..(69): a, c, t, g, unknown or other
  modified_base (90)..(90): a, c, t, g, unknown or other
  modified_base (103)..(103): a, c, t, g, unknown or other
  modified_base (129)..(129): a, c, t, g, unknown or other
  modified_base (140)..(165): a, c, t, g, unknown or other
  modified_base (244)..(244): a, c, t, g, unknown or other
  modified_base (310)..(310): a, c, t, g, unknown or other
  modified_base (317)..(317): a, c, t, g, unknown or other
tatacatgttctgatantncaaactgaaatctcatcttctttcccactttattgaaagactacaggtanggataaaagaaaactaccaantaacagatctganagtacaaaatatttttaatcatgacntcccccctccnnnnnnnnnnnnnnnnnnnnnnnnnncctttcaagagaaactaacctwctttagatccattgtcaattcttttccagaatctcttaactaaaagatttagttacngtaatgtatatacatacagcaatygcaaaaatgtctttgggataaagacattatcttrtaactcantcaaatnagacaatatgaacatactg

SEQ ID NO: 4496 - DNA, 523 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  misc_feature (197)..(198): This region may encompass 'ca' or tc'
  modified_base (240)..(240): a, c, t, g, unknown or other
  modified_base (242)..(242): a, c, t, g, unknown or other
  modified_base (280)..(280): a, c, t, g, unknown or other
  modified_base (282)..(282): a, c, t, g, unknown or other
  modified_base (334)..(334): a, c, t, g, unknown or other
  modified_base (337)..(337): a, c, t, g, unknown or other
  modified_base (360)..(360): a, c, t, g, unknown or other
  modified_base (390)..(390): a, c, t, g, unknown or other
  modified_base (393)..(393): a, c, t, g, unknown or other
  modified_base (400)..(400): a, c, t, g, unknown or other
  modified_base (410)..(410): a, c, t, g, unknown or other
  modified_base (413)..(413): a, c, t, g, unknown or other
  modified_base (425)..(425): a, c, t, g, unknown or other
  modified_base (447)..(447): a, c, t, g, unknown or other
  modified_base (454)..(454): a, c, t, g, unknown or other
  modified_base (466)..(466): a, c, t, g, unknown or other
  modified_base (469)..(469): a, c, t, g, unknown or other
  modified_base (476)..(476): a, c, t, g, unknown or other
  modified_base (498)..(498): a, c, t, g, unknown or other
  modified_base (500)..(500): a, c, t, g, unknown or other
  modified_base (510)..(510): a, c, t, g, unknown or other
  modified_base (514)..(514): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccanccccttcngttctgtggcattgncacaatymaggaatctacttttgtgcttttacacattgaactgacaggtnanrtcaggcatcgactgtcacaggggccagtggagaggtngnagggacgcccacattcgatgaatcctgcatcayggtgttggacttcttgttnttngacactaaacttgttcacattynataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4497 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcyttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4498 - DNA, 225 bp, Artificial Sequence
  Description of Artificial Sequence: Synthetic polynucleotide
  modified_base (9)..(9): a, c, t, g, unknown or other
  modified_base (26)..(26): a, c, t, g, unknown or other
  modified_base (163)..(163): a, c, t, g, unknown or other
  modified_base (211)..(211): a, c, t, g, unknown or other
tgtcagccnctctcctccccagatancgctctgtcatcagccaaggaacaaattccccatgaaagrcattattctttctctcaagaagatcaactacttatatttcttcctttgctgacagctttgcagggtgaacatctagaatttaaaaaagggttgatgnggacaagtgagctctctgtgtgactcaccaggatgttccctcttattncaggtgtcctgtcc

SEQ ID NO: 4499 - DNA, 458 bp, Artificial Sequence
  Description of Artificial Sequence: Synthetic polynucleotide
  modified_base (75)..(75): a, c, t, g, unknown or other
  modified_base (80)..(80): a, c, t, g, unknown or other
  modified_base (139)..(139): a, c, t, g, unknown or other
  modified_base (157)..(157): a, c, t, g, unknown or other
  modified_base (161)..(161): a, c, t, g, unknown or other
  modified_base (187)..(187): a, c, t, g, unknown or other
  modified_base (216)..(216): a, c, t, g, unknown or other
  modified_base (281)..(281): a, c, t, g, unknown or other
  modified_base (316)..(316): a, c, t, g, unknown or other
  modified_base (331)..(331): a, c, t, g, unknown or other
  modified_base (333)..(333): a, c, t, g, unknown or other
  modified_base (402)..(402): a, c, t, g, unknown or other
  modified_base (420)..(420): a, c, t, g, unknown or other
tggggaagaaaatgtaatacaaattaatataccaacagcaattagtgagtactttytccatggagctgggagagngaatngtttgtaaaattaaaatgttctacgctagaaatcaactttccttctatgcyttctttanttcaccccttatagctanttantaaatctcacaaatcctatccttctnatctctctgaaatgtatgtaccctttccnttctattctcaccacccatgtttctttgtttccttctagcctgtgtaataatctcataatckyanctcctgtacctgccttctttctagtccagaatacnttttcctaaattccncnaataaccatcctgctactgctttgtgtgaaattctccaaaaaaaattttacttttccaaaataagtcangctccctctcttaggatncaaaaccacaccatggtcccagccaatctttcagcctg

SEQ ID NO: 4500 - DNA, 148 bp, Artificial Sequence
  Description of Artificial Sequence: Synthetic polynucleotide
  modified_base (48)..(48): a, c, t, g, unknown or other
  modified_base (134)..(134): a, c, t, g, unknown or other
tccattttctacttgagcattaaaatatcaggaagaaaaagaagatanaccatatagcagttggtaaaataagatatctgccccagcacagyccatactaagtattcagaatttacagttatattagataactnaaattagataacta

SEQ ID NO: 4501 - DNA, 793 bp, Artificial Sequence
  Description of Artificial Sequence: Synthetic polynucleotide
  modified_base (9)..(9): a, c, t, g, unknown or other
  modified_base (61)..(61): a, c, t, g, unknown or other
  modified_base (79)..(79): a, c, t, g, unknown or other
  modified_base (110)..(110): a, c, t, g, unknown or other
  modified_base (112)..(112): a, c, t, g, unknown or other
  modified_base (125)..(125): a, c, t, g, unknown or other
  modified_base (155)..(155): a, c, t, g, unknown or other
  modified_base (162)..(162): a, c, t, g, unknown or other
  modified_base (197)..(197): a, c, t, g, unknown or other
  modified_base (208)..(208): a, c, t, g, unknown or other
  modified_base (218)..(218): a, c, t, g, unknown or other
  modified_base (229)..(229): a, c, t, g, unknown or other
  modified_base (240)..(240): a, c, t, g, unknown or other
  modified_base (251)..(251): a, c, t, g, unknown or other
  modified_base (256)..(256): a, c, t, g, unknown or other
  modified_base (277)..(277): a, c, t, g, unknown or other
  modified_base (281)..(281): a, c, t, g, unknown or other
  modified_base (302)..(302): a, c, t, g, unknown or other
  modified_base (315)..(315): a, c, t, g, unknown or other
  modified_base (328)..(328): a, c, t, g, unknown or other
  modified_base (343)..(343): a, c, t, g, unknown or other
  modified_base (349)..(349): a, c, t, g, unknown or other
  modified_base (361)..(361): a, c, t, g, unknown or other
  modified_base (389)..(389): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  misc_feature (474)..(474): May or may not be present
  modified_base (487)..(487): a, c, t, g, unknown or other
  modified_base (496)..(496): a, c, t, g, unknown or other
  modified_base (518)..(518): a, c, t, g, unknown or other
  modified_base (533)..(533): a, c, t, g, unknown or other
  modified_base (542)..(542): a, c, t, g, unknown or other
  modified_base (552)..(552): a, c, t, g, unknown or other
  modified_base (601)..(601): a, c, t, g, unknown or other
  modified_base (608)..(608): a, c, t, g, unknown or other
  modified_base (619)..(619): a, c, t, g, unknown or other
  modified_base (625)..(625): a, c, t, g, unknown or other
  modified_base (633)..(633): a, c, t, g, unknown or other
  modified_base (638)..(638): a, c, t, g, unknown or other
  modified_base (641)..(641): a, c, t, g, unknown or other
  modified_base (643)..(643): a, c, t, g, unknown or other
  modified_base (655)..(655): a, c, t, g, unknown or other
  modified_base (682)..(682): a, c, t, g, unknown or other
  modified_base (698)..(698): a, c, t, g, unknown or other
  modified_base (723)..(723): a, c, t, g, unknown or other
  modified_base (752)..(752): a, c, t, g, unknown or other
  modified_base (759)..(759): a, c, t, g, unknown or other
  modified_base (785)..(785): a, c, t, g, unknown or other
aaagttctncttactagaaaaaaggattgtgaattcttcccacttctcacttatcatctgntaagcattttgcagatangacatctagatatgggaaaacataagaaaantntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactagaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcnttactttgtactctacagtgcttgtttanctcttanggggtttgttctattaaattacactncataataa

SEQ ID NO: 4502 - DNA, 722 bp, Artificial Sequence
  Description of Artificial Sequence: Synthetic polynucleotide
  modified_base (12)..(12): a, c, t, g, unknown or other
  modified_base (32)..(32): a, c, t, g, unknown or other
  modified_base (60)..(60): a, c, t, g, unknown or other
  modified_base (76)..(76): a, c, t, g, unknown or other
  modified_base (79)..(79): a, c, t, g, unknown or other
  modified_base (96)..(96): a, c, t, g, unknown or other
  modified_base (118)..(118): a, c, t, g, unknown or other
  modified_base (152)..(152): a, c, t, g, unknown or other
  modified_base (218)..(218): a, c, t, g, unknown or other
  modified_base (225)..(225): a, c, t, g, unknown or other
  modified_base (233)..(233): a, c, t, g, unknown or other
  modified_base (243)..(243): a, c, t, g, unknown or other
  modified_base (245)..(245): a, c, t, g, unknown or other
  modified_base (284)..(284): a, c, t, g, unknown or other
  modified_base (293)..(293): a, c, t, g, unknown or other
  modified_base (298)..(335): a, c, t, g, unknown or other
  modified_base (339)..(339): a, c, t, g, unknown or other
  modified_base (359)..(359): a, c, t, g, unknown or other
  modified_base (387)..(387): a, c, t, g, unknown or other
  modified_base (394)..(394): a, c, t, g, unknown or other
  modified_base (407)..(407): a, c, t, g, unknown or other
  modified_base (438)..(438): a, c, t, g, unknown or other
  modified_base (444)..(444): a, c, t, g, unknown or other
  modified_base (574)..(574): a, c, t, g, unknown or other
  modified_base (579)..(579): a, c, t, g, unknown or other
  modified_base (593)..(593): a, c, t, g, unknown or other
  modified_base (609)..(609): a, c, t, g, unknown or other
  modified_base (626)..(626): a, c, t, g, unknown or other
  modified_base (659)..(659): a, c, t, g, unknown or other
  modified_base (670)..(670): a, c, t, g, unknown or other
  modified_base (672)..(672): a, c, t, g, unknown or other
  modified_base (694)..(694): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
atggaccaaggngaagtaaattttgtgtttgnagtacctttaattctttctgtccatccnaaatattctaaccccnaancccatgccatgagtggnttttagggaaagaattaagacnatgttgtaaaatcttgtaagttgcagtttgcagnattagtattggaccaacaatgtcctcccactcaagtggcataacrgtagaaaacactgttactagntagaaanagaatstnaggggagaancnatagtctaaactacagaacccagrttaaaatagaaaaantctgtactnttccnnnnnnnnnnnnnnnnnnnnnnnnnnnnnnnnnnnnnnctgnaaataaacagtattataaantggtatatttaaacaaataaatatctanctacaangtaattctttttnatctaatcttgaaccagtggttctggctccntcttancttgtcataatctttgtaactcatcttgaatgcttttttggagttgcacctgttccttggtttatatatgctccagggatttcttgtcagctggccrtaagacatgatttggcaatttgtcattccattnactgnattcatttagctgntaaaattgacacttanggatastttagtttcangaatccttcttataacagtgggctttcacaatntccttcctatncntgcagaaataatcctccacaancnaagcacaaaagaaaaatnagnttggt

SEQ ID NO: 4503 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaaytgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4504 - DNA, 610 bp, Artificial Sequence
  Description of Artificial Sequence: Synthetic polynucleotide
  modified_base (44)..(44): a, c, t, g, unknown or other
  modified_base (160)..(160): a, c, t, g, unknown or other
  modified_base (227)..(227): a, c, t, g, unknown or other
  modified_base (319)..(319): a, c, t, g, unknown or other
  modified_base (350)..(350): a, c, t, g, unknown or other
  modified_base (356)..(356): a, c, t, g, unknown or other
  modified_base (496)..(526): a, c, t, g, unknown or other
  modified_base (592)..(592): a, c, t, g, unknown or other
  modified_base (602)..(602): a, c, t, g, unknown or other
tatttactttggtaccaattctagatatayatctgcatataccnggtatttaacttcctggtctcatgttccttaaatagttaataagaaagagtaattatgaaccatgcagascaattaacaagcctaacttccaatattttcttcactctgaartaantatttccaacaktgtattatgtcagaagttctcrgttttgggggtgctgtatcttaatttttctgtnctctaktttcaacttcactgamataatacaagctctatcttccttacaaatttataaggaatcaaatgaaatgaaatatataaaagttgtcntctttctcccatcttcaaaaaacttcccccngcaytncatttcctgttarccctctctccttcaacagcctggtctgtagaaagagtccatacatggcctccctccactscctcatcttccattcaytccttgttccaaggycctcccaacaccactgaaacttttttcaatgcccnnnnnnnnnnnnnnnnnnnnnnnnnnnnnnngcaaattctgcccccawcttttcattctttcagttgaaccactttttccaaaacactgtgcagatntaaaaaatangtagttaa

SEQ ID NO: 4505 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (846)..(846): a, c, t, g, unknown or other
  modified_base (870)..(870): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctyactgnaaagaaccaaacaaggaaaatacnaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4506 - DNA, 599 bp, Artificial Sequence
  Description of Artificial Sequence: Synthetic polynucleotide
  modified_base (3)..(3): a, c, t, g, unknown or other
  modified_base (75)..(75): a, c, t, g, unknown or other
  modified_base (80)..(80): a, c, t, g, unknown or other
  modified_base (143)..(143): a, c, t, g, unknown or other
  modified_base (169)..(169): a, c, t, g, unknown or other
  modified_base (174)..(174): a, c, t, g, unknown or other
  modified_base (188)..(188): a, c, t, g, unknown or other
  modified_base (195)..(195): a, c, t, g, unknown or other
  modified_base (200)..(200): a, c, t, g, unknown or other
  modified_base (211)..(211): a, c, t, g, unknown or other
  modified_base (216)..(216): a, c, t, g, unknown or other
  modified_base (269)..(269): a, c, t, g, unknown or other
  modified_base (496)..(496): a, c, t, g, unknown or other
  modified_base (507)..(507): a, c, t, g, unknown or other
  modified_base (548)..(548): a, c, t, g, unknown or other
  modified_base (593)..(593): a, c, t, g, unknown or other
ggnacttctgaggggtgaagaacttgaagggagaataatataacttattagtcaaataaatgaaaatatcataantgtgnatatgttcttgtgagtgggggtagctcagcagtgtgtgttcatccccagaaaagagaaaatcntgtctgctgtggaaagaagacatagnttttnacatatgtggttantattaangacanctgagcctggntactngatcatgttataatgctaaagggaagattcaatagaagaaagaatgtcatagnaaaaacaaaaaaattaagcatcaaagatttaaatgaaatgactttgaatattactagtaatgaacatgccaagaaaaatcaattactataaccagaagaataattcatgactgcccatgggattcatgctgagaagatatacaatttccatttaatttccatttactgaaaattaaattaaatttagtgagggctcatcactaccctcataaaatggttcagagagnaagcgaagaanakagtgtgagcttacagcaagtggagaccatctcttctccnaatgtcccacagctccacagcccacctgtccaggttctatcaagnaatttt

SEQ ID NO: 4507 - DNA, 215 bp, Artificial Sequence
  Description of Artificial Sequence: Synthetic polynucleotide
  modified_base (18)..(18): a, c, t, g, unknown or other
  modified_base (48)..(48): a, c, t, g, unknown or other
  modified_base (85)..(85): a, c, t, g, unknown or other
  misc_feature (149)..(150): This region may encompass 'ca' or 'tc'
gaaacatctaagaccaanttgatctaggttgaaactagttgggcttcnctgaacttgcacttctgcagtttactgactggagggngttttattatttactggcttgcattgggcaaattatctaacgaggatctgcaccacctttcttymatcttcctggaaacaagagactagctgagatatgtttgtctcatggtagtgaaagaggcacaaat

SEQ ID NO: 4508 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgrctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4509 - DNA, 194 bp, Artificial Sequence
  Description of Artificial Sequence: Synthetic polynucleotide
  modified_base (24)..(24): a, c, t, g, unknown or other
  modified_base (27)..(27): a, c, t, g, unknown or other
  modified_base (33)..(33): a, c, t, g, unknown or other
  modified_base (41)..(41): a, c, t, g, unknown or other
  modified_base (43)..(43): a, c, t, g, unknown or other
  modified_base (50)..(50): a, c, t, g, unknown or other
  modified_base (64)..(64): a, c, t, g, unknown or other
  modified_base (69)..(69): a, c, t, g, unknown or other
  modified_base (78)..(78): a, c, t, g, unknown or other
  modified_base (99)..(99): a, c, t, g, unknown or other
  modified_base (104)..(104): a, c, t, g, unknown or other
  modified_base (115)..(115): a, c, t, g, unknown or other
  modified_base (149)..(149): a, c, t, g, unknown or other
  modified_base (155)..(155): a, c, t, g, unknown or other
  modified_base (175)..(175): a, c, t, g, unknown or other
caaagactatcaagacctggaarnagnagtgcngtcttttngnatgacgntgtcctgaagacangcctngatattggnagaaacaaagtggaagatgcnttctncaaaggtgaantcaggctgaatggggaaaarttatggaagaaaancagaanggtcaaagtgggagatacantggatcttctcattggaga

SEQ ID NO: 4510 - DNA, 312 bp, Artificial Sequence
  Description of Artificial Sequence: Synthetic polynucleotide
  modified_base (110)..(110): a, c, t, g, unknown or other
  modified_base (178)..(178): a, c, t, g, unknown or other
  modified_base (185)..(185): a, c, t, g, unknown or other
  modified_base (192)..(192): a, c, t, g, unknown or other
  modified_base (216)..(216): a, c, t, g, unknown or other
  modified_base (277)..(277): a, c, t, g, unknown or other
  modified_base (279)..(279): a, c, t, g, unknown or other
  modified_base (291)..(291): a, c, t, g, unknown or other
ggtaaatggaatgcttagagaatgctattttagagaatgctattttaacactatggtaatcaaacttttccaagttatatatgctttacattgtattacaggaaaaaganatgtttatcaaatacattttaaaatcaagttgttaactccttcaatattctcagtattagagataacntatttcngtaatgncatgaacagggtatttgtcttttnttttttattatatttggtctatatttraggccaattccataacaatctgataatggctatngncttatgactaanccatgaaaagaaaagtttata

SEQ ID NO: 4511 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggrctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4512 - DNA, 132 bp, Artificial Sequence
  Description of Artificial Sequence: Synthetic polynucleotide
  modified_base (21)..(21): a, c, t, g, unknown or other
  modified_base (38)..(38): a, c, t, g, unknown or other
  misc_feature (58)..(63): This region may encompass 'tcaact' or is absent in its entirety
  modified_base (90)..(90): a, c, t, g, unknown or other
  modified_base (96)..(96): a, c, t, g, unknown or other
  modified_base (123)..(123): a, c, t, g, unknown or other
ggattgaagatttcctccacnaccagctgaaaawattntttggaaacacctccctcatcaactccttgttctccttcaaattccacatanaactgncttcaagtctgcaggattttccatagngatcatctc

SEQ ID NO: 4513 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1028)..(1028): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccygcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4514 - DNA, 109 bp, Artificial Sequence
  Description of Artificial Sequence: Synthetic polynucleotide
  modified_base (47)..(47): a, c, t, g, unknown or other
  modified_base (89)..(89): a, c, t, g, unknown or other
  modified_base (95)..(95): a, c, t, g, unknown or other
  modified_base (98)..(98): a, c, t, g, unknown or other
taccttgctgcatgagagctccaactccaaaccagaaactatttagnaargtaaaattgttttccaccacgtctgagtcagggttgcangggtgnggnttataccactc

SEQ ID NO: 4515 - DNA, 301 bp, Artificial Sequence
  Description of Artificial Sequence: Synthetic polynucleotide
  modified_base (37)..(37): a, c, t, g, unknown or other
  modified_base (51)..(51): a, c, t, g, unknown or other
  modified_base (75)..(75): a, c, t, g, unknown or other
  modified_base (119)..(119): a, c, t, g, unknown or other
  modified_base (124)..(124): a, c, t, g, unknown or other
  modified_base (129)..(129): a, c, t, g, unknown or other
  modified_base (166)..(166): a, c, t, g, unknown or other
  modified_base (168)..(168): a, c, t, g, unknown or other
  modified_base (174)..(174): a, c, t, g, unknown or other
  modified_base (206)..(206): a, c, t, g, unknown or other
  modified_base (245)..(245): a, c, t, g, unknown or other
  modified_base (250)..(250): a, c, t, g, unknown or other
  modified_base (270)..(270): a, c, t, g, unknown or other
  modified_base (280)..(280): a, c, t, g, unknown or other
  modified_base (297)..(297): a, c, t, g, unknown or other
tgattgmttcaacataaatactatggyttatttctanatggcaaggaaaantcacrtgtaagaggtttccwtttnaaagaattccactattcatcaaaattttcatctattctcaagantgttnatttnaaactaggtttrgagtagcaaagcatatgaattttanantagaanacatgagaaggatataaaagtttgttttctgnattctttcaaaattcttattttgaaggccttctgggcanataanctattggaacttgtcatcanttaaactatntcctataaagatgarantcag

SEQ ID NO: 4516 - DNA, 146 bp, Artificial Sequence
  Description of Artificial Sequence: Synthetic polynucleotide
  modified_base (11)..(11): a, c, t, g, unknown or other
  modified_base (50)..(50): a, c, t, g, unknown or other
  modified_base (54)..(54): a, c, t, g, unknown or other
  modified_base (57)..(57): a, c, t, g, unknown or other
  modified_base (100)..(100): a, c, t, g, unknown or other
taactgttttncaaagtgactcatggcccaagttttggacagaaatatgntttnaanatgttacattattcagttattttgactttatgttgcaccyagnattttaatccactcaatatgaatgtggaatataataaaacaatagc

SEQ ID NO: 4517 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagsacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4518 - DNA, 250 bp, Artificial Sequence
  Description of Artificial Sequence: Synthetic polynucleotide
  modified_base (4)..(4): a, c, t, g, unknown or other
  modified_base (20)..(20): a, c, t, g, unknown or other
  misc_feature (48)..(49): This region may encompass 'tg' or 'ca'
  modified_base (66)..(66): a, c, t, g, unknown or other
  modified_base (74)..(74): a, c, t, g, unknown or other
  modified_base (96)..(96): a, c, t, g, unknown or other
  modified_base (113)..(113): a, c, t, g, unknown or other
  modified_base (115)..(115): a, c, t, g, unknown or other
  modified_base (149)..(149): a, c, t, g, unknown or other
  modified_base (171)..(171): a, c, t, g, unknown or other
  modified_base (176)..(176): a, c, t, g, unknown or other
  modified_base (178)..(178): a, c, t, g, unknown or other
  modified_base (186)..(186): a, c, t, g, unknown or other
  modified_base (189)..(189): a, c, t, g, unknown or other
  modified_base (198)..(198): a, c, t, g, unknown or other
  modified_base (208)..(208): a, c, t, g, unknown or other
  modified_base (231)..(231): a, c, t, g, unknown or other
  modified_base (233)..(233): a, c, t, g, unknown or other
  modified_base (246)..(246): a, c, t, g, unknown or other
tttntaagaatgttgtcatngagtgtgtcacttaaggtcttagactgyraatctaaccatatttantgaaatgncttactgtacaaaaagtctaanccaaaggttctcagggnanaaagcacatgtgcagttttaaaacaaagcagtgntttgtcccattgctgtgatttntagtnanactttacncantctgaaatncaattaacantaaaggattaagtgtgagatttngntttatgctatttntgta

SEQ ID NO: 4519 - DNA, 663 bp, Artificial Sequence
  Description of Artificial Sequence: Synthetic polynucleotide
  misc_feature (25)..(25): May or may not be present
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (240)..(240): a, c, t, g, unknown or other
  modified_base (336)..(336): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (593)..(593): a, c, t, g, unknown or other
  modified_base (596)..(596): a, c, t, g, unknown or other
  modified_base (601)..(601): a, c, t, g, unknown or other
  modified_base (614)..(614): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaaaccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccngtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggnggtaagagggctcgccagagccagnaggngngngggcagggtccctgtg

SEQ ID NO: 4520 - DNA, 186 bp, Artificial Sequence
  Description of Artificial Sequence: Synthetic polynucleotide
  modified_base (13)..(13): a, c, t, g, unknown or other
ggtttgacagttnatactggcttatttcattttatccattttctgcctgtatttgaccacactttatcttygccaggcaattattgtggaaatgtccgtgaatcttctcacagctacatttgacatttacttttgcagtggacatcagagttgaagtctgttctgtgtccaccagagacttcagat

SEQ ID NO: 4521 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttccncttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataakagcacattttcacctangactggcaggtggtcacanctcagctnagagagtcccantnganagcncantctgctgncatgtaactaagtgattttttnccnctgaaagtttatgtact

SEQ ID NO: 4522 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaargtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4523 - DNA, 673 bp, Artificial Sequence
  Description of Artificial Sequence: Synthetic polynucleotide
  modified_base (14)..(14): a, c, t, g, unknown or other
  modified_base (78)..(78): a, c, t, g, unknown or other
  modified_base (87)..(87): a, c, t, g, unknown or other
  modified_base (110)..(110): a, c, t, g, unknown or other
  modified_base (134)..(134): a, c, t, g, unknown or other
  modified_base (139)..(139): a, c, t, g, unknown or other
  modified_base (164)..(164): a, c, t, g, unknown or other
  modified_base (180)..(180): a, c, t, g, unknown or other
  modified_base (277)..(277): a, c, t, g, unknown or other
  modified_base (285)..(285): a, c, t, g, unknown or other
  modified_base (297)..(297): a, c, t, g, unknown or other
  modified_base (360)..(360): a, c, t, g, unknown or other
  modified_base (370)..(370): a, c, t, g, unknown or other
  modified_base (498)..(498): a, c, t, g, unknown or other
  modified_base (615)..(615): a, c, t, g, unknown or other
  modified_base (672)..(672): a, c, t, g, unknown or other
cgcgactatgctgnctccttcccatccagcaaagctcctgcttcaggccctcagatggactgaccacagtagcaccgncccatcctnctggacccaggatgcacctgccngagcgcctgagtgccctgagccantgcangggstctcccagggctcaccaggcngcactttccttgyagngctccctgtggattgccatggctgctaggagagcttygyggaggagacgctgacggagaccaactgcaggaacactgtggacttgttgaggaggctngggrctgnccctcggcrccngcatggtgctgggacgcaggaggctcggggctgcccccttggtgcatgmacrgtgctgggacnctgtcagacnctcctgtctttgccccgaagcagaggccaagagaggcacaagggccgcacacctgcctgctcctcttggacrcgggtgcccgagcataccctgcaagtgtgcagtctgtcctccaggctgatgcctgnaacacagaccctgtcctgtgccacacccagggctggtctctgaggacctctgtgcagagcyggtgttggccccaggtcccttccctcccagtccaggagctgtagcttgttggcagngggctccatatgcctgagaccaacctgccccctgcacatggatgttgggctgtcacng

SEQ ID NO: 4524 - DNA, 150 bp, Artificial Sequence
  Description of Artificial Sequence: Synthetic polynucleotide
  modified_base (71)..(71): a, c, t, g, unknown or other
aaaataaaagattaatcaatttgactacatacraaaattgggtttacactctgatgtctaacctatacaanatcccatactaagagccttagtgctacatatatttagacagataaaatttctggaagctctttcagttcctttttcctg

SEQ ID NO: 4525 - DNA, 87 bp, Artificial Sequence
  Description of Artificial Sequence: Synthetic oligonucleotide
  modified_base (52)..(52): a, c, t, g, unknown or other
actcccattattactcttcagtagaaaataactttggggtaacaargaaggnaggataaaatacacaaataaacttggtagaagcat

SEQ ID NO: 4526 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagyaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4527 - DNA, 866 bp, Artificial Sequence
  Description of Artificial Sequence: Synthetic polynucleotide
  modified_base (14)..(14): a, c, t, g, unknown or other
  modified_base (32)..(32): a, c, t, g, unknown or other
  modified_base (49)..(49): a, c, t, g, unknown or other
  modified_base (69)..(69): a, c, t, g, unknown or other
  modified_base (73)..(73): a, c, t, g, unknown or other
  modified_base (96)..(96): a, c, t, g, unknown or other
  modified_base (100)..(100): a, c, t, g, unknown or other
  modified_base (122)..(122): a, c, t, g, unknown or other
  modified_base (129)..(129): a, c, t, g, unknown or other
  modified_base (138)..(138): a, c, t, g, unknown or other
  modified_base (162)..(162): a, c, t, g, unknown or other
  modified_base (179)..(179): a, c, t, g, unknown or other
  modified_base (193)..(193): a, c, t, g, unknown or other
  modified_base (261)..(261): a, c, t, g, unknown or other
  modified_base (280)..(280): a, c, t, g, unknown or other
  modified_base (297)..(297): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
  modified_base (376)..(376): a, c, t, g, unknown or other
  modified_base (402)..(402): a, c, t, g, unknown or other
  modified_base (416)..(416): a, c, t, g, unknown or other
  modified_base (429)..(429): a, c, t, g, unknown or other
  modified_base (442)..(442): a, c, t, g, unknown or other
  modified_base (461)..(461): a, c, t, g, unknown or other
  modified_base (479)..(479): a, c, t, g, unknown or other
  modified_base (490)..(490): a, c, t, g, unknown or other
  modified_base (504)..(504): a, c, t, g, unknown or other
  modified_base (508)..(508): a, c, t, g, unknown or other
  modified_base (511)..(511): a, c, t, g, unknown or other
  modified_base (583)..(583): a, c, t, g, unknown or other
  modified_base (617)..(617): a, c, t, g, unknown or other
  modified_base (648)..(648): a, c, t, g, unknown or other
  modified_base (673)..(673): a, c, t, g, unknown or other
  modified_base (697)..(697): a, c, t, g, unknown or other
  modified_base (711)..(711): a, c, t, g, unknown or other
  modified_base (716)..(716): a, c, t, g, unknown or other
  modified_base (733)..(733): a, c, t, g, unknown or other
  modified_base (798)..(798): a, c, t, g, unknown or other
  modified_base (800)..(800): a, c, t, g, unknown or other
  modified_base (814)..(814): a, c, t, g, unknown or other
  modified_base (828)..(828): a, c, t, g, unknown or other
  modified_base (837)..(837): a, c, t, g, unknown or other
  modified_base (854)..(854): a, c, t, g, unknown or other
agtctgatgcttcnccttatctgccacttcanaratacacaggagaaangggttaattttgtctgaaancaancacaattagggctaataaataanttanaggtggggtactgtaacatatncttaccnactaaatangtaaaccatttgaatcaagtccancttcaggcacaaacaanttaggaatggccanctacactggagtagcataacctatcaagtatttggttagaaaataagtgtactatttgtgtgataaantttcactttaaatggattntaaaattattttcccanamacatgacagtttcttatatttggactrgangtcnctaataaagatacatttagttgncccagcaaagaatgcttagnattgcacatggaagcagtaaactaanacaaagagatgganaatgacatttagntattttcctatanagataagatttgcaattgnactcttaacaaaactcanctctacaattnaatacagatggggnaaanctncatattaacttaaatactcttttagccctgtacactctattaaagaacacacttctaaatctaaggcrcacnattcctctatttcacagagtaagattatggaagnarcaagattttggttaaatcccttacaatgnccaggagatcttggacagaagacanttatatagcattttgttagtgcanaatttaaaagaaantgctntgactatgctctggtcntagaggtttaaaacatgcactcaaatcattaaaaataatttaccagcacyttataaattcaagtntnaacataaaagtganacgttttccttaanaagaaaaanacccaacagcacttggnaagaaaattaga

SEQ ID NO: 4528 - DNA, 398 bp, Artificial Sequence
  Description of Artificial Sequence: Synthetic polynucleotide
  modified_base (5)..(5): a, c, t, g, unknown or other
  modified_base (30)..(30): a, c, t, g, unknown or other
  modified_base (42)..(42): a, c, t, g, unknown or other
  modified_base (55)..(55): a, c, t, g, unknown or other
  modified_base (57)..(57): a, c, t, g, unknown or other
  modified_base (77)..(77): a, c, t, g, unknown or other
  modified_base (94)..(94): a, c, t, g, unknown or other
  modified_base (97)..(97): a, c, t, g, unknown or other
  modified_base (99)..(99): a, c, t, g, unknown or other
  modified_base (118)..(118): a, c, t, g, unknown or other
  modified_base (170)..(170): a, c, t, g, unknown or other
  modified_base (180)..(180): a, c, t, g, unknown or other
  modified_base (187)..(187): a, c, t, g, unknown or other
  modified_base (202)..(202): a, c, t, g, unknown or other
  modified_base (206)..(206): a, c, t, g, unknown or other
  modified_base (226)..(226): a, c, t, g, unknown or other
  modified_base (232)..(232): a, c, t, g, unknown or other
  modified_base (234)..(234): a, c, t, g, unknown or other
  modified_base (247)..(247): a, c, t, g, unknown or other
  modified_base (327)..(327): a, c, t, g, unknown or other
  modified_base (334)..(334): a, c, t, g, unknown or other
  modified_base (342)..(342): a, c, t, g, unknown or other
  modified_base (350)..(350): a, c, t, g, unknown or other
  modified_base (367)..(367): a, c, t, g, unknown or other
  modified_base (374)..(374): a, c, t, g, unknown or other
  modified_base (391)..(391): a, c, t, g, unknown or other
tcccncaaatccatctacatcaaatttgtngaagtagagagngattttctttccncnggctctttagttgagtgccngaaaaagccaytggatnccncntaaaatttaacaactgaangtcatccttcataaggatttgggctcttagctccttcttctctactcacttnccattacccngaccacncctcatccagatgcngccntcagactcttcatggaaacnctttcntnattgggccagtangacttctaaggaatcatagtagacttkggccagaaaaaacagacctcacctgaaaatgctcattttgagcaagcaagatntatagcnaacttgcntggtgggncagctatttcttttttnaaaacanaaaaacaatttttaaanggatttt

SEQ ID NO: 4529 - DNA, 118 bp, Artificial Sequence
  Description of Artificial Sequence: Synthetic polynucleotide
  modified_base (6)..(6): a, c, t, g, unknown or other
  modified_base (14)..(14): a, c, t, g, unknown or other
tttttnccattttngaaggtttggtcaatcctatcaatttctctctgactcayacgttctttcttttccagtcaagcatcttgaaacagagtaaaaatatatttcttttatttgtacc

SEQ ID NO: 4530 - DNA, 276 bp, Artificial Sequence
  Description of Artificial Sequence: Synthetic polynucleotide
  modified_base (95)..(95): a, c, t, g, unknown or other
  modified_base (190)..(190): a, c, t, g, unknown or other
tctacatttcactatgtgctggtaaattcactccatcaaatcatcaccaatgtaagtccaataggcattgctaaactactaaaaaaaaaaatttncattattttctttgcatatttctttttacgaaacgcrctcttggttttcaaaaaggttctgaatttagatgtacggaataggaaaatttctccanggtgattatatttgataattgataaatacttgtatttttcatagtaagccttgaccgaagggcccatattaaggaagatggagtta

SEQ ID NO: 4531 - DNA, 225 bp, Artificial Sequence
  Description of Artificial Sequence: Synthetic polynucleotide
  modified_base (34)..(34): a, c, t, g, unknown or other
  modified_base (98)..(98): a, c, t, g, unknown or other
  modified_base (137)..(137): a, c, t, g, unknown or other
  modified_base (177)..(177): a, c, t, g, unknown or other
  modified_base (187)..(187): a, c, t, g, unknown or other
cacaaaagatatgtagtaaaaacaatggtgtggngaaaacaaaatcttgcaaactagaaaaaagacagtccccggtcccgtgtggtccygtcccgccncggggccagccagctgtaagctccacgcagttcaacaanggcccctcctacaggctcttggcggacgtccagaaccggntcctgtccanatatgactcscagaaggaggtagagctccgcagctgga

SEQ ID NO: 4532 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctytggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4533 - DNA, 665 bp, Artificial Sequence
  Description of Artificial Sequence: Synthetic polynucleotide
  modified_base (39)..(39): a, c, t, g, unknown or other
  modified_base (45)..(45): a, c, t, g, unknown or other
  modified_base (48)..(48): a, c, t, g, unknown or other
  modified_base (62)..(62): a, c, t, g, unknown or other
  modified_base (70)..(70): a, c, t, g, unknown or other
  modified_base (84)..(84): a, c, t, g, unknown or other
  modified_base (89)..(89): a, c, t, g, unknown or other
  modified_base (108)..(108): a, c, t, g, unknown or other
  modified_base (113)..(113): a, c, t, g, unknown or other
  modified_base (130)..(130): a, c, t, g, unknown or other
  modified_base (140)..(140): a, c, t, g, unknown or other
  modified_base (162)..(162): a, c, t, g, unknown or other
  modified_base (165)..(165): a, c, t, g, unknown or other
  modified_base (193)..(193): a, c, t, g, unknown or other
  modified_base (197)..(197): a, c, t, g, unknown or other
  modified_base (224)..(224): a, c, t, g, unknown or other
  modified_base (226)..(226): a, c, t, g, unknown or other
  modified_base (230)..(230): a, c, t, g, unknown or other
  modified_base (235)..(235): a, c, t, g, unknown or other
  modified_base (245)..(245): a, c, t, g, unknown or other
  modified_base (250)..(250): a, c, t, g, unknown or other
  modified_base (252)..(252): a, c, t, g, unknown or other
  modified_base (266)..(266): a, c, t, g, unknown or other
  modified_base (278)..(278): a, c, t, g, unknown or other
  modified_base (291)..(291): a, c, t, g, unknown or other
  modified_base (305)..(305): a, c, t, g, unknown or other
  modified_base (322)..(322): a, c, t, g, unknown or other
  modified_base (352)..(352): a, c, t, g, unknown or other
  modified_base (363)..(363): a, c, t, g, unknown or other
  modified_base (367)..(367): a, c, t, g, unknown or other
  modified_base (395)..(395): a, c, t, g, unknown or other
  modified_base (429)..(429): a, c, t, g, unknown or other
  modified_base (444)..(444): a, c, t, g, unknown or other
  modified_base (460)..(460): a, c, t, g, unknown or other
  modified_base (477)..(477): a, c, t, g, unknown or other
  modified_base (486)..(486): a, c, t, g, unknown or other
  modified_base (488)..(488): a, c, t, g, unknown or other
  modified_base (493)..(493): a, c, t, g, unknown or other
  modified_base (510)..(510): a, c, t, g, unknown or other
  modified_base (515)..(515): a, c, t, g, unknown or other
  modified_base (517)..(517): a, c, t, g, unknown or other
  modified_base (519)..(519): a, c, t, g, unknown or other
  modified_base (539)..(539): a, c, t, g, unknown or other
  modified_base (559)..(559): a, c, t, g, unknown or other
  modified_base (561)..(561): a, c, t, g, unknown or other
  modified_base (597)..(597): a, c, t, g, unknown or other
  modified_base (607)..(607): a, c, t, g, unknown or other
  modified_base (609)..(609): a, c, t, g, unknown or other
  modified_base (615)..(615): a, c, t, g, unknown or other
  modified_base (621)..(621): a, c, t, g, unknown or other
  modified_base (640)..(640): a, c, t, g, unknown or other
  modified_base (642)..(642): a, c, t, g, unknown or other
  modified_base (644)..(644): a, c, t, g, unknown or other
caggcagcacctcacrgaatccaggctcacagaaagtcngtttcnatnagaatttaaaacanccctcttntgctgcaactcttnaggcnactgacaaggtgacaggancacantttgtacaggatacaancatattcccnatgggtggacaaaacgaccccntancccrtctacaccaaggagctgcacctgngccntgtgtagccagatgcaattttctattntngganaatcnactttaagtngttcntnagcaaattcttccnaagtactgtttnctttcctcaattnctggcctagcaagntagaaagaaaacaaaangaatgtaaaatgttcttggttgactttacncttaattactnaaangcaaacagagaaaattaaaatcaaacantgcaaaaaattcttctagagccttgcacacaatnccagttcttgaaatnttcataaagcaaagcnaatgaaataaacaaagncrtggctgnanggatntgcattgtactrtgctnatggncnanttgctcactgcatctctcgntccacygccrccrggctcrncnccagaagcctgttcctgagctgattggggttctggnccaggggtcncnaggagngaggcncaagctcaggaggacaaanancnaccacctggaaagtggcaaaa

SEQ ID NO: 4534 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccrgcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4535 - DNA, 2010 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  misc_feature (202)..(204): This region may encompass 'tat' or is absent in its entirety
  modified_base (208)..(208): a, c, t, g, unknown or other
  modified_base (241)..(241): a, c, t, g, unknown or other
  modified_base (282)..(282): a, c, t, g, unknown or other
  modified_base (285)..(285): a, c, t, g, unknown or other
  modified_base (292)..(292): a, c, t, g, unknown or other
  modified_base (309)..(309): a, c, t, g, unknown or other
  modified_base (395)..(395): a, c, t, g, unknown or other
  modified_base (400)..(400): a, c, t, g, unknown or other
  modified_base (402)..(402): a, c, t, g, unknown or other
  modified_base (422)..(422): a, c, t, g, unknown or other
  modified_base (424)..(424): a, c, t, g, unknown or other
  modified_base (446)..(446): a, c, t, g, unknown or other
  modified_base (451)..(451): a, c, t, g, unknown or other
  modified_base (454)..(454): a, c, t, g, unknown or other
  modified_base (468)..(468): a, c, t, g, unknown or other
  modified_base (501)..(501): a, c, t, g, unknown or other
  modified_base (527)..(527): a, c, t, g, unknown or other
  modified_base (534)..(534): a, c, t, g, unknown or other
  modified_base (543)..(543): a, c, t, g, unknown or other
  modified_base (545)..(545): a, c, t, g, unknown or other
  modified_base (548)..(548): a, c, t, g, unknown or other
  modified_base (559)..(559): a, c, t, g, unknown or other
  modified_base (575)..(575): a, c, t, g, unknown or other
  modified_base (585)..(585): a, c, t, g, unknown or other
  modified_base (599)..(599): a, c, t, g, unknown or other
  modified_base (614)..(614): a, c, t, g, unknown or other
  modified_base (672)..(672): a, c, t, g, unknown or other
  modified_base (695)..(695): a, c, t, g, unknown or other
  modified_base (708)..(708): a, c, t, g, unknown or other
  modified_base (711)..(711): a, c, t, g, unknown or other
  modified_base (727)..(727): a, c, t, g, unknown or other
  modified_base (900)..(900): a, c, t, g, unknown or other
  modified_base (917)..(917): a, c, t, g, unknown or other
  modified_base (948)..(948): a, c, t, g, unknown or other
  modified_base (957)..(957): a, c, t, g, unknown or other
  modified_base (961)..(961): a, c, t, g, unknown or other
  modified_base (1082)..(1082): a, c, t, g, unknown or other
  modified_base (1106)..(1106): a, c, t, g, unknown or other
  modified_base (1155)..(1155): a, c, t, g, unknown or other
  modified_base (1217)..(1217): a, c, t, g, unknown or other
  modified_base (1253)..(1253): a, c, t, g, unknown or other
  modified_base (1288)..(1288): a, c, t, g, unknown or other
  modified_base (1383)..(1383): a, c, t, g, unknown or other
  modified_base (1425)..(1425): a, c, t, g, unknown or other
  modified_base (1516)..(1516): a, c, t, g, unknown or other
  modified_base (1523)..(1523): a, c, t, g, unknown or other
  modified_base (1532)..(1532): a, c, t, g, unknown or other
  modified_base (1553)..(1553): a, c, t, g, unknown or other
  modified_base (1580)..(1580): a, c, t, g, unknown or other
  modified_base (1588)..(1588): a, c, t, g, unknown or other
  modified_base (1632)..(1632): a, c, t, g, unknown or other
  modified_base (1649)..(1649): a, c, t, g, unknown or other
  modified_base (1652)..(1652): a, c, t, g, unknown or other
  modified_base (1797)..(1797): a, c, t, g, unknown or other
  modified_base (1799)..(1799): a, c, t, g, unknown or other
  modified_base (1846)..(1846): a, c, t, g, unknown or other
  modified_base (1869)..(1869): a, c, t, g, unknown or other
  modified_base (1956)..(1956): a, c, t, g, unknown or other
  modified_base (1967)..(1967): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccattatcttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4536 - DNA, 653 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (171)..(171): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (348)..(348): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  modified_base (510)..(510): a, c, t, g, unknown or other
  modified_base (550)..(550): a, c, t, g, unknown or other
  modified_base (574)..(574): a, c, t, g, unknown or other
  modified_base (615)..(615): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatnaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgntttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagaccctnatcatatctagcttttaacctaccagttatgcacctagcntcaaaaacaccatttcctccgagnttsacaagcctactgaaatcaccatagttctttagtaagcntcagaagcctggagtatggatgtatatttttctcctgt

SEQ ID NO: 4537 - DNA, 794 bp, Artificial Sequence
  Description of Artificial Sequence: Synthetic polynucleotide
  modified_base (9)..(9): a, c, t, g, unknown or other
  misc_feature (61)..(62): This region may encompass 'at' or is absent in its entirety
  modified_base (80)..(80): a, c, t, g, unknown or other
  modified_base (111)..(111): a, c, t, g, unknown or other
  modified_base (113)..(113): a, c, t, g, unknown or other
  modified_base (126)..(126): a, c, t, g, unknown or other
  modified_base (156)..(156): a, c, t, g, unknown or other
  modified_base (163)..(163): a, c, t, g, unknown or other
  modified_base (198)..(198): a, c, t, g, unknown or other
  modified_base (209)..(209): a, c, t, g, unknown or other
  modified_base (219)..(219): a, c, t, g, unknown or other
  modified_base (230)..(230): a, c, t, g, unknown or other
  modified_base (241)..(241): a, c, t, g, unknown or other
  modified_base (252)..(252): a, c, t, g, unknown or other
  modified_base (257)..(257): a, c, t, g, unknown or other
  modified_base (278)..(278): a, c, t, g, unknown or other
  modified_base (282)..(282): a, c, t, g, unknown or other
  modified_base (303)..(303): a, c, t, g, unknown or other
  modified_base (316)..(316): a, c, t, g, unknown or other
  modified_base (329)..(329): a, c, t, g, unknown or other
  modified_base (344)..(344): a, c, t, g, unknown or other
  modified_base (350)..(350): a, c, t, g, unknown or other
  modified_base (362)..(362): a, c, t, g, unknown or other
  modified_base (390)..(390): a, c, t, g, unknown or other
  modified_base (402)..(402): a, c, t, g, unknown or other
  modified_base (413)..(413): a, c, t, g, unknown or other
  modified_base (436)..(436): a, c, t, g, unknown or other
  modified_base (475)..(475): a, c, t, g, unknown or other
  modified_base (488)..(488): a, c, t, g, unknown or other
  modified_base (497)..(497): a, c, t, g, unknown or other
  modified_base (519)..(519): a, c, t, g, unknown or other
  modified_base (534)..(534): a, c, t, g, unknown or other
  modified_base (543)..(543): a, c, t, g, unknown or other
  modified_base (553)..(553): a, c, t, g, unknown or other
  modified_base (602)..(602): a, c, t, g, unknown or other
  modified_base (609)..(609): a, c, t, g, unknown or other
  modified_base (620)..(620): a, c, t, g, unknown or other
  modified_base (626)..(626): a, c, t, g, unknown or other
  modified_base (634)..(634): a, c, t, g, unknown or other
  modified_base (639)..(639): a, c, t, g, unknown or other
  modified_base (642)..(642): a, c, t, g, unknown or other
  modified_base (644)..(644): a, c, t, g, unknown or other
  modified_base (656)..(656): a, c, t, g, unknown or other
  modified_base (683)..(683): a, c, t, g, unknown or other
  modified_base (699)..(699): a, c, t, g, unknown or other
  modified_base (724)..(724): a, c, t, g, unknown or other
  modified_base (753)..(753): a, c, t, g, unknown or other
  modified_base (760)..(760): a, c, t, g, unknown or other
  modified_base (786)..(786): a, c, t, g, unknown or other
aaagttctncttactagaaaaaaggattgtgaattcttcccacttctcacttatcatctgattaagcattttgcagatangacatctagatatgggaaaacataagaaaantntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactngaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcnttactttgtactctacagtgcttgtttanctcttanggggtttgttctattaaattacactncataataa

SEQ ID NO: 4538 - DNA, 200 bp, Artificial Sequence
  Description of Artificial Sequence: Synthetic polynucleotide
  modified_base (17)..(17): a, c, t, g, unknown or other
  modified_base (31)..(31): a, c, t, g, unknown or other
  modified_base (66)..(66): a, c, t, g, unknown or other
  modified_base (98)..(98): a, c, t, g, unknown or other
  modified_base (102)..(102): a, c, t, g, unknown or other
  modified_base (112)..(112): a, c, t, g, unknown or other
  modified_base (114)..(114): a, c, t, g, unknown or other
  modified_base (116)..(116): a, c, t, g, unknown or other
atgcatatcacaaagtntgtggaaaaaaaantgtttcccttccttatcctttgggtcttctcyttnaattaacctctgtttcaaaatactggragctnaatntgaataaaanananaaagtttgccaaactagaactcmggtcagtgttcaggaaccaaaatcttgctttattgatacctacagaaaattccygggwtat

SEQ ID NO: 4539 - DNA, 151 bp, Artificial Sequence
  Description of Artificial Sequence: Synthetic polynucleotide
  modified_base (62)..(62): a, c, t, g, unknown or other
  modified_base (70)..(70): a, c, t, g, unknown or other
tacttcttcctatactggtttattattccaataaaattcctatattcctgaatttttttttnctttctanttctcwggtattcattactcygtaacctcttccaaatgacatacawacttgaaaaatagtgagaaaaaacttcttctagtt

SEQ ID NO: 4540 - DNA, 422 bp, Artificial Sequence
  Description of Artificial Sequence: Synthetic polynucleotide
  modified_base (13)..(13): a, c, t, g, unknown or other
  modified_base (17)..(17): a, c, t, g, unknown or other
  modified_base (27)..(27): a, c, t, g, unknown or other
  modified_base (45)..(45): a, c, t, g, unknown or other
  modified_base (52)..(52): a, c, t, g, unknown or other
  modified_base (55)..(55): a, c, t, g, unknown or other
  modified_base (66)..(66): a, c, t, g, unknown or other
  modified_base (76)..(76): a, c, t, g, unknown or other
  misc_feature (120)..(123): This region may encompass 'ggtt' or is absent in its entirety
  modified_base (127)..(127): a, c, t, g, unknown or other
  modified_base (137)..(137): a, c, t, g, unknown or other
  modified_base (141)..(141): a, c, t, g, unknown or other
  modified_base (161)..(161): a, c, t, g, unknown or other
  modified_base (201)..(201): a, c, t, g, unknown or other
  modified_base (222)..(222): a, c, t, g, unknown or other
  modified_base (241)..(241): a, c, t, g, unknown or other
  modified_base (271)..(271): a, c, t, g, unknown or other
  modified_base (286)..(286): a, c, t, g, unknown or other
  modified_base (288)..(288): a, c, t, g, unknown or other
  modified_base (312)..(312): a, c, t, g, unknown or other
  modified_base (356)..(356): a, c, t, g, unknown or other
  modified_base (373)..(373): a, c, t, g, unknown or other
  modified_base (383)..(383): a, c, t, g, unknown or other
  modified_base (389)..(389): a, c, t, g, unknown or other
  modified_base (397)..(397): a, c, t, g, unknown or other
  modified_base (408)..(408): a, c, t, g, unknown or other
  modified_base (415)..(415): a, c, t, g, unknown or other
aagagmaagaganctanaggccctagnaaaaggcaatggcaaagncagatantgnctttcacyccnccactatctntccagaaaaccccatgtaaaccttgagcacactgcaaagtcatggtttggncaggtttctnctcnagcaagaaagccccatgccnccctgccagttcactggggcctctcaggcaccattctyancatgagctattggttgggtcnggtatgtaggggagctgcngtgccactgaagtcacgtgataattgtggnctcctggccaggaancngctgatctagcttggggacagrgnggcaggatgtgccaytgattcccttgtgagaaattcctaagaanctactctccatctgcanttaattctcncagganaattaagngattttttttntctcttntctaaag

SEQ ID NO: 4541 - DNA, 358 bp, Artificial Sequence
  Description of Artificial Sequence: Synthetic polynucleotide
  modified_base (48)..(48): a, c, t, g, unknown or other
  modified_base (55)..(55): a, c, t, g, unknown or other
  modified_base (117)..(117): a, c, t, g, unknown or other
  modified_base (123)..(123): a, c, t, g, unknown or other
  modified_base (147)..(147): a, c, t, g, unknown or other
  modified_base (169)..(169): a, c, t, g, unknown or other
  modified_base (178)..(178): a, c, t, g, unknown or other
  modified_base (215)..(215): a, c, t, g, unknown or other
  modified_base (224)..(224): a, c, t, g, unknown or other
  modified_base (227)..(227): a, c, t, g, unknown or other
  modified_base (254)..(254): a, c, t, g, unknown or other
  modified_base (266)..(266): a, c, t, g, unknown or other
  modified_base (279)..(279): a, c, t, g, unknown or other
  modified_base (295)..(295): a, c, t, g, unknown or other
  modified_base (298)..(298): a, c, t, g, unknown or other
  modified_base (304)..(304): a, c, t, g, unknown or other
  modified_base (318)..(318): a, c, t, g, unknown or other
  modified_base (324)..(324): a, c, t, g, unknown or other
  modified_base (341)..(341): a, c, t, g, unknown or other
ctgctgccgtagagcctggagcagcacgaccggcttggccttctccanccccagncagcamtgcagaggacaccgcagggactccccaagtgtccgcaccccygggcctgccagggncctccncctgctgggctgccctccctgtgngcaaggtgtgaggagattcttngagagagtntcccctgggttgcagagtcctratggaatctcacagnaaaattgcntgncccccaatgtcctaggtgtagcgttcntttcagtttttncattagaaatgtntccctgaaggctcatntcngtgccntgagaaaagagaangccatngtcacaataaccctccnttctgaccaggatggag

SEQ ID NO: 4542 - DNA, 3431 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  misc_feature (2493)..(2497): This region may encompass 'aatat' or is absent in its entirety
  modified_base (2591)..(2591): a, c, t, g, unknown or other
  modified_base (2652)..(2652): a, c, t, g, unknown or other
  modified_base (2839)..(2839): a, c, t, g, unknown or other
  modified_base (2886)..(2886): a, c, t, g, unknown or other
  modified_base (2919)..(2919): a, c, t, g, unknown or other
  modified_base (2937)..(2937): a, c, t, g, unknown or other
  modified_base (2960)..(2960): a, c, t, g, unknown or other
  modified_base (2962)..(2962): a, c, t, g, unknown or other
  modified_base (2974)..(2974): a, c, t, g, unknown or other
  modified_base (3010)..(3010): a, c, t, g, unknown or other
  modified_base (3032)..(3032): a, c, t, g, unknown or other
  modified_base (3106)..(3106): a, c, t, g, unknown or other
  modified_base (3387)..(3387): a, c, t, g, unknown or other
  modified_base (3414)..(3414): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtaatatgactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4543 - DNA, 374 bp, Artificial Sequence
  Description of Artificial Sequence: Synthetic polynucleotide
  modified_base (16)..(16): a, c, t, g, unknown or other
  modified_base (22)..(22): a, c, t, g, unknown or other
  modified_base (47)..(47): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (145)..(145): a, c, t, g, unknown or other
  modified_base (148)..(148): a, c, t, g, unknown or other
  modified_base (153)..(153): a, c, t, g, unknown or other
  modified_base (156)..(156): a, c, t, g, unknown or other
  modified_base (176)..(176): a, c, t, g, unknown or other
  modified_base (193)..(193): a, c, t, g, unknown or other
  modified_base (201)..(201): a, c, t, g, unknown or other
  modified_base (234)..(234): a, c, t, g, unknown or other
  modified_base (276)..(276): a, c, t, g, unknown or other
  modified_base (309)..(309): a, c, t, g, unknown or other
  modified_base (321)..(321): a, c, t, g, unknown or other
  modified_base (326)..(326): a, c, t, g, unknown or other
  modified_base (334)..(334): a, c, t, g, unknown or other
  modified_base (349)..(349): a, c, t, g, unknown or other
  modified_base (354)..(354): a, c, t, g, unknown or other
  modified_base (363)..(363): a, c, t, g, unknown or other
caaagtttatatcaanaaaagnggtaaatatttaaaaactgagtttntcaagtagtgtctccctttcattcyccttgcagataaactttcaaacyntngaatatttctccacnacctgaagaatcaggatcaagctctcaaaatnccnagtgngtntttctgacaggtcgtagggntgayctcttgaacatgnccaagatnttttggttgctcatcctatcatgatgtcctgwncatctttcagaaatggaacccatattgatggattcaatgtangcaaaattccactatctaccagatagctgtgcnttcttcattttncaggnagaaacanggttgtagattagantatgntacagcaantattcacctcc

SEQ ID NO: 4544 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancasagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4545 - DNA, 471 bp, Artificial Sequence
  Description of Artificial Sequence: Synthetic polynucleotide
  modified_base (35)..(35): a, c, t, g, unknown or other
  modified_base (42)..(42): a, c, t, g, unknown or other
  modified_base (67)..(67): a, c, t, g, unknown or other
  modified_base (72)..(72): a, c, t, g, unknown or other
  modified_base (99)..(99): a, c, t, g, unknown or other
  modified_base (101)..(101): a, c, t, g, unknown or other
  modified_base (118)..(118): a, c, t, g, unknown or other
  modified_base (120)..(120): a, c, t, g, unknown or other
  modified_base (171)..(171): a, c, t, g, unknown or other
  modified_base (173)..(173): a, c, t, g, unknown or other
  modified_base (177)..(177): a, c, t, g, unknown or other
  modified_base (193)..(193): a, c, t, g, unknown or other
  modified_base (204)..(204): a, c, t, g, unknown or other
  modified_base (212)..(212): a, c, t, g, unknown or other
  modified_base (229)..(229): a, c, t, g, unknown or other
  modified_base (238)..(238): a, c, t, g, unknown or other
  modified_base (269)..(269): a, c, t, g, unknown or other
  modified_base (381)..(381): a, c, t, g, unknown or other
  modified_base (400)..(400): a, c, t, g, unknown or other
  modified_base (404)..(404): a, c, t, g, unknown or other
tgaccataggctttstygagattagaaataactgnttctttnaaagagaatgcctgcattaaccaantatanaagatatgtagcaaatgctacatttgnantcatcataaagctgaangnaaaaagaaacactgcaaacatactgaaacaattaagcaatgttcgttcctnantttnggctgggaagaatatnctttgtgcacngtatagtnrgtaagacaacattctnaggcccacnttttagttagttaccaactcctagaagccantggaaaatcacagtctttgatgtgtaaaataactgagaaaargggtrtagagccttataaaatacctgagcttcatctggaccagccaggagcaagacttgaaatcctcttnctgaggaaaatgaaggaangcanacttgccttttgaggcacaaaataaaagaaacctataaaatttgkgtggcacartgtcccagaaatc

SEQ ID NO: 4546 - DNA, 424 bp, Artificial Sequence
  Description of Artificial Sequence: Synthetic polynucleotide
  modified_base (204)..(204): a, c, t, g, unknown or other
  modified_base (216)..(216): a, c, t, g, unknown or other
  modified_base (268)..(268): a, c, t, g, unknown or other
  modified_base (306)..(306): a, c, t, g, unknown or other
  modified_base (381)..(381): a, c, t, g, unknown or other
taataatacttctatggtttcttgcagctctcccaaaatacatttacatacataaaagctcattcacatacatgcacacacacacattatcacagctcttcccctctccccaacaattcattccagatgccattagatggtgctaagtgtggcaggtgattgccccgggaarcacagcaagatgagaaggtttaggaggagcangagaagttgccnagggcctgggcagacagaggcagatgaggggcaggcaaggtggtaacagccnaccaaagagtgtcccatgtgagtaaaggacatgggctnagcagcaggaggctcaatggtggcactagtacacaagataaatactgggtaaatgatgaaataaatcartaggyngagaatatctgggtggcatggttctatgaaagcattgtaaata

SEQ ID NO: 4547 - DNA, 886 bp, Artificial Sequence
  Description of Artificial Sequence: Synthetic polynucleotide
  modified_base (77)..(77): a, c, t, g, unknown or other
  modified_base (117)..(153): a, c, t, g, unknown or other
  modified_base (237)..(237): a, c, t, g, unknown or other
  modified_base (263)..(263): a, c, t, g, unknown or other
  modified_base (365)..(365): a, c, t, g, unknown or other
  modified_base (391)..(391): a, c, t, g, unknown or other
  modified_base (399)..(422): a, c, t, g, unknown or other
  modified_base (441)..(441): a, c, t, g, unknown or other
  modified_base (461)..(461): a, c, t, g, unknown or other
  modified_base (466)..(466): a, c, t, g, unknown or other
  modified_base (574)..(574): a, c, t, g, unknown or other
  modified_base (603)..(603): a, c, t, g, unknown or other
  modified_base (627)..(627): a, c, t, g, unknown or other
  modified_base (666)..(666): a, c, t, g, unknown or other
  modified_base (676)..(676): a, c, t, g, unknown or other
  modified_base (684)..(684): a, c, t, g, unknown or other
  modified_base (695)..(695): a, c, t, g, unknown or other
  modified_base (739)..(739): a, c, t, g, unknown or other
  modified_base (752)..(752): a, c, t, g, unknown or other
  modified_base (756)..(756): a, c, t, g, unknown or other
gtgcactgtcacttgagaatttcaaattatatgataagtagctaaggcagtcaaagaaaggctttggagatgaccanaaagtacyttatgtaactaagttattcagtccctaaaccnnnnnnnnnnnnnnnnnnnnnnnnnnnnnnnnnnnnngatacaggaaaaaagagcttgtcaaaaaatctcaaaagaataaagtctattggatttaaaccatttccttataaaacctgattnctgtattacagatatgaactctatangcactcaaatcctttcatcaataaaaggcaataagactcttattgagtaacaataagaggcaataaggctcttattgactgtaacattatttaggatagttntttccaatagaaatatcaagaccaangggttacnnnnnnnnnnnnnnnnnnnnnnnngtcagtactataccatcanctctgcaaggtaactgctcngaaanagagcctgaggaatcttttctgatcacagatcttttggttttcccttgcccagttcgacttctttgccgcaccataaatccaccaatacctatccaaaaaagaaattnggtaaactgataartaatttctccctacntttccacagtacacaggataaaantgctttatcttgaatagtaagtcattttccaaaattaantctgtgctantctaaatnaataacctganttttaggtaaaatagaagttaaaaacraccaaaaaaaaaaaaangrcaaagccactnttancacttatcaaacagaatacaaaaagacctgtgtgcacttcctcttctcaacagtatcagtgtaaatatcaaacactaaattacgctggcttatctatttgacaaatattagtgcctcatacatcacataa

SEQ ID NO: 4548 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagaygtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4549 - DNA, 692 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (453)..(453): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (568)..(568): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcraaggcaacaggcagggccaccaggctgctgtgtggcnaatangacatnacccagagaagcggcctgagngggccccnccngnctcctgctggctcccrcccacctccc

SEQ ID NO: 4550 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  misc_feature (412)..(412): May or may not be present
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttcctcttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 4551 - DNA, 744 bp, Artificial Sequence
  Description of Artificial Sequence: Synthetic polynucleotide
  modified_base (58)..(58): a, c, t, g, unknown or other
  modified_base (261)..(261): a, c, t, g, unknown or other
  modified_base (286)..(286): a, c, t, g, unknown or other
  modified_base (347)..(347): a, c, t, g, unknown or other
  modified_base (356)..(356): a, c, t, g, unknown or other
  modified_base (396)..(396): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacantcctcccacgacaaagttttaccytcagkaattgtgctcacaacagctttcctcctagagntttctgccnagaacatacacaggtgcctagaagactcctggcttatctnaactgtagacamtgaatctctatcgggaacctgtttttttcaccaacccaggtttcttggactacctgatcataatctcttctgattgtrtgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 4552 - DNA, 1277 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  misc_feature (215)..(216): This region may encompass 'tt' or is absent in its entirety
  modified_base (271)..(271): a, c, t, g, unknown or other
  modified_base (304)..(304): a, c, t, g, unknown or other
  modified_base (313)..(313): a, c, t, g, unknown or other
  modified_base (318)..(318): a, c, t, g, unknown or other
  modified_base (323)..(323): a, c, t, g, unknown or other
  modified_base (329)..(329): a, c, t, g, unknown or other
  modified_base (344)..(344): a, c, t, g, unknown or other
  modified_base (356)..(356): a, c, t, g, unknown or other
  modified_base (358)..(358): a, c, t, g, unknown or other
  modified_base (466)..(466): a, c, t, g, unknown or other
  modified_base (491)..(569): a, c, t, g, unknown or other
  modified_base (584)..(584): a, c, t, g, unknown or other
  modified_base (631)..(631): a, c, t, g, unknown or other
  modified_base (652)..(652): a, c, t, g, unknown or other
  modified_base (732)..(732): a, c, t, g, unknown or other
  modified_base (748)..(748): a, c, t, g, unknown or other
  modified_base (756)..(756): a, c, t, g, unknown or other
  modified_base (836)..(836): a, c, t, g, unknown or other
  modified_base (860)..(860): a, c, t, g, unknown or other
  modified_base (902)..(902): a, c, t, g, unknown or other
  modified_base (936)..(936): a, c, t, g, unknown or other
  modified_base (1052)..(1052): a, c, t, g, unknown or other
  modified_base (1069)..(1069): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatattatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4553 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaayagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4554 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagntcttttaatccttcccaagaaactgagngcagatayaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4555 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrsagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4556 - DNA, 246 bp, Artificial Sequence
  Description of Artificial Sequence: Synthetic polynucleotide
  modified_base (95)..(95): a, c, t, g, unknown or other
  modified_base (125)..(125): a, c, t, g, unknown or other
  modified_base (193)..(193): a, c, t, g, unknown or other
  modified_base (207)..(207): a, c, t, g, unknown or other
  modified_base (245)..(245): a, c, t, g, unknown or other
acatacattagatctgagtaagaatgcatcacttagggggaagggaagcagatgcttatctattttgtcttatctactgataactaaattcaganattgtaataaaagtaatacaaatgttatanttttctcttaatttttaaagagcaacgattayagtctgaaaaactgtcattcagcgactartgccatnctgaggccaaatcnttttggttttcaatatccagctttatcatgtcacaatna

SEQ ID NO: 4557 - DNA, 221 bp, Artificial Sequence
  Description of Artificial Sequence: Synthetic polynucleotide
  modified_base (13)..(13): a, c, t, g, unknown or other
  modified_base (20)..(20): a, c, t, g, unknown or other
  modified_base (35)..(35): a, c, t, g, unknown or other
  modified_base (43)..(43): a, c, t, g, unknown or other
  modified_base (63)..(63): a, c, t, g, unknown or other
  modified_base (96)..(96): a, c, t, g, unknown or other
  modified_base (124)..(124): a, c, t, g, unknown or other
  modified_base (126)..(126): a, c, t, g, unknown or other
  modified_base (166)..(166): a, c, t, g, unknown or other
  modified_base (169)..(169): a, c, t, g, unknown or other
  modified_base (191)..(191): a, c, t, g, unknown or other
  modified_base (202)..(202): a, c, t, g, unknown or other
  modified_base (205)..(205): a, c, t, g, unknown or other
  modified_base (211)..(211): a, c, t, g, unknown or other
aatcctctttttnatgagtntctgaaactggagcngttcaacnttatccagtgtgaaaatcantgagtcctccctggcatcctcgtgaaagtgcanacacttcatggagggactccttttmaantnagaattaggaagatgagaaagtaatttgagattttactyngtngaattttagagtatttgaagtnattgttagatnttncttctnaggagttgat

SEQ ID NO: 4558 - DNA, 692 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (568)..(568): a, c, t, g, unknown or other
  modified_base (584)..(584): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctykatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 4559 - DNA, 663 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (240)..(240): a, c, t, g, unknown or other
  modified_base (336)..(336): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (596)..(596): a, c, t, g, unknown or other
  modified_base (601)..(601): a, c, t, g, unknown or other
  modified_base (614)..(614): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccngtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtkcanagganccccctcctgggnggtaagagggctcgccagagccagnaggngngngggcagggtccctgtg

SEQ ID NO: 4560 - DNA, 127 bp, Artificial Sequence
  Description of Artificial Sequence: Synthetic polynucleotide
  modified_base (5)..(5): a, c, t, g, unknown or other
  modified_base (8)..(8): a, c, t, g, unknown or other
  modified_base (26)..(26): a, c, t, g, unknown or other
  modified_base (39)..(39): a, c, t, g, unknown or other
  modified_base (70)..(70): a, c, t, g, unknown or other
  modified_base (80)..(80): a, c, t, g, unknown or other
  modified_base (86)..(86): a, c, t, g, unknown or other
  modified_base (91)..(91): a, c, t, g, unknown or other
cttanttnaatctgaagcttgcccancattttctcacgncaccttaatttgcaaaagtggagcttgggtnaaatgaggantgaaanaagangaaasagaaggaggtcatattgagtgtaaaaaatgt

SEQ ID NO: 4561 - DNA, 671 bp, Artificial Sequence
  Description of Artificial Sequence: Synthetic polynucleotide
  modified_base (29)..(29): a, c, t, g, unknown or other
  modified_base (44)..(44): a, c, t, g, unknown or other
  modified_base (61)..(61): a, c, t, g, unknown or other
  modified_base (78)..(78): a, c, t, g, unknown or other
  modified_base (84)..(84): a, c, t, g, unknown or other
  modified_base (88)..(88): a, c, t, g, unknown or other
  modified_base (170)..(170): a, c, t, g, unknown or other
  modified_base (216)..(216): a, c, t, g, unknown or other
  modified_base (226)..(226): a, c, t, g, unknown or other
  modified_base (229)..(229): a, c, t, g, unknown or other
  modified_base (234)..(234): a, c, t, g, unknown or other
  modified_base (258)..(258): a, c, t, g, unknown or other
  modified_base (363)..(430): a, c, t, g, unknown or other
  modified_base (481)..(481): a, c, t, g, unknown or other
  modified_base (503)..(503): a, c, t, g, unknown or other
  modified_base (559)..(559): a, c, t, g, unknown or other
  modified_base (639)..(639): a, c, t, g, unknown or other
  modified_base (646)..(646): a, c, t, g, unknown or other
  modified_base (657)..(657): a, c, t, g, unknown or other
  modified_base (670)..(670): a, c, t, g, unknown or other
ttgctttttcaatggggacataatcacanagatgcagatgtgtngtgcaaagaacacacangcaccagataaaataancataantgcncyttctacagacagaacacctggctttgtggaaagttagaaggccacacaatgcctcagaaaatgcataaaataaactaaanctaagcactaaattcaatactaaaaccccttcatctgggactcaangttaccattncgnttagnatgcaactataawaacatatgccnaaactttccaaaaacccacaatcttgaaagaaagtggtcccrtgacatgcaggtatctgagttagcagttctgcttcaatgaagagaaagcaaaaaggaaaaggnnnnnnnnnnnnnnnnnnnnnnnnnnnnnnnnnnnnnnnnnnnnnnnnnnnnnnnnnnnnnnnnnnnncctccctttaaacatgaaggaacaaatgrcaaggtaagaacaaataatatnataggtttcaataaacaatatntttattcataattattacctgtctctggcattccctatccaccagtctagaaaaanatgtgacaaaaatgaaacaaaagaataaaatacatttttttctaacttgctgatagaagsttgatcattggaactctaantgcatgnaaaagtcttcnatctaatttaaana

SEQ ID NO: 4562 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttrttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4563 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (409)..(409): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctntatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacmaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4564 - DNA, 516 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (48)..(48): a, c, t, g, unknown or other
  modified_base (57)..(57): a, c, t, g, unknown or other
  modified_base (62)..(62): a, c, t, g, unknown or other
  modified_base (94)..(94): a, c, t, g, unknown or other
  modified_base (118)..(118): a, c, t, g, unknown or other
  modified_base (120)..(120): a, c, t, g, unknown or other
  modified_base (133)..(133): a, c, t, g, unknown or other
  modified_base (162)..(162): a, c, t, g, unknown or other
  modified_base (173)..(173): a, c, t, g, unknown or other
  modified_base (184)..(184): a, c, t, g, unknown or other
  modified_base (215)..(215): a, c, t, g, unknown or other
  modified_base (218)..(218): a, c, t, g, unknown or other
  modified_base (243)..(243): a, c, t, g, unknown or other
  modified_base (250)..(250): a, c, t, g, unknown or other
  modified_base (258)..(258): a, c, t, g, unknown or other
  modified_base (272)..(272): a, c, t, g, unknown or other
  modified_base (274)..(274): a, c, t, g, unknown or other
  modified_base (305)..(305): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (335)..(335): a, c, t, g, unknown or other
  modified_base (381)..(381): a, c, t, g, unknown or other
  modified_base (413)..(413): a, c, t, g, unknown or other
  modified_base (441)..(441): a, c, t, g, unknown or other
  modified_base (456)..(456): a, c, t, g, unknown or other
  modified_base (458)..(458): a, c, t, g, unknown or other
  modified_base (477)..(477): a, c, t, g, unknown or other
  modified_base (480)..(480): a, c, t, g, unknown or other
  modified_base (495)..(495): a, c, t, g, unknown or other
  modified_base (500)..(500): a, c, t, g, unknown or other
  modified_base (513)..(513): a, c, t, g, unknown or other
tanccaaaagaangtatgtacttatgaatgtattccatatttatttanggatttttnggtanctttttgcaaatgatggtaaacatgragttanaaacctgagaacagattataaaananaaggttaagaagngtttaaataaattaatggatttgacatcnatcaccagttnttaaaattagnaagtaaaaggcatcccattagtcttttcagntcntagtcaaggacaatkatcatgaatnaatctgnttactatntacttaacacaagntntgagaagaaaagcatcatagttctgaaatgntgatngntcnctaagccacaaatgagaggnaggtttcccacctatctcagttgataatgtccaaaaacatccttcnccatgcatcagagtagaaagaraatgtacctnctactatgtcaaatggaatagataactncaaartaggaacacntnagaacattctctaacattntancagtctgatgcttcnccttntctgccacttcanara

SEQ ID NO: 4565 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcasacagctgagattatgatagattcattagtaagctgaatgggraagraaaggatattyacattccnaggccaattttcaatgctttttggaagattctgttaaattc

SEQ ID NO: 4566 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (351)..(351): a, c, t, g, unknown or other
  modified_base (429)..(429): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (737)..(737): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggyagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagngtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4567 - DNA, 722 bp, Artificial Sequence
  Description of Artificial Sequence: Synthetic polynucleotide
  modified_base (12)..(12): a, c, t, g, unknown or other
  modified_base (32)..(32): a, c, t, g, unknown or other
  modified_base (60)..(60): a, c, t, g, unknown or other
  modified_base (76)..(76): a, c, t, g, unknown or other
  modified_base (79)..(79): a, c, t, g, unknown or other
  modified_base (96)..(96): a, c, t, g, unknown or other
  modified_base (118)..(118): a, c, t, g, unknown or other
  modified_base (218)..(218): a, c, t, g, unknown or other
  modified_base (225)..(225): a, c, t, g, unknown or other
  modified_base (233)..(233): a, c, t, g, unknown or other
  modified_base (243)..(243): a, c, t, g, unknown or other
  modified_base (245)..(245): a, c, t, g, unknown or other
  modified_base (284)..(284): a, c, t, g, unknown or other
  modified_base (293)..(293): a, c, t, g, unknown or other
  modified_base (298)..(335): a, c, t, g, unknown or other
  modified_base (339)..(339): a, c, t, g, unknown or other
  modified_base (359)..(359): a, c, t, g, unknown or other
  modified_base (387)..(387): a, c, t, g, unknown or other
  modified_base (394)..(394): a, c, t, g, unknown or other
  modified_base (407)..(407): a, c, t, g, unknown or other
  modified_base (438)..(438): a, c, t, g, unknown or other
  modified_base (444)..(444): a, c, t, g, unknown or other
  modified_base (541)..(541): a, c, t, g, unknown or other
  modified_base (574)..(574): a, c, t, g, unknown or other
  modified_base (579)..(579): a, c, t, g, unknown or other
  modified_base (593)..(593): a, c, t, g, unknown or other
  modified_base (609)..(609): a, c, t, g, unknown or other
  modified_base (626)..(626): a, c, t, g, unknown or other
  modified_base (659)..(659): a, c, t, g, unknown or other
  modified_base (670)..(670): a, c, t, g, unknown or other
  modified_base (672)..(672): a, c, t, g, unknown or other
  modified_base (694)..(694): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
atggaccaaggngaagtaaattttgtgtttgnagtacctttaattctttctgtccatccnaaatattctaaccccnaancccatgccatgagtggnttttagggaaagaattaagacnatgttgtaaaatcttgtaagttgcagtttgcagrattagtattggaccaacaatgtcctcccactcaagtggcataacrgtagaaaacactgttactagntagaaanagaatstnaggggagaancnatagtctaaactacagaacccagrttaaaatagaaaaantctgtactnttccnnnnnnnnnnnnnnnnnnnnnnnnnnnnnnnnnnnnnnctgnaaataaacagtattataaantggtatatttaaacaaataaatatctanctacaangtaattctttttnatctaatcttgaaccagtggttctggctccntcttancttgtcataatctttgtaactcatcttgaatgcttttttggagttgcacctgttccttggtttatatatgctccagggatttcttgtcagctggccntaagacatgatttggcaatttgtcattccattnactgnattcatttagctgntaaaattgacacttanggatastttagtttcangaatccttcttataacagtgggctttcacaatntccttcctatncntgcagaaataatcctccacaancnaagcacaaaagaaaaatnagnttggt

SEQ ID NO: 4568 - DNA, 162 bp, Artificial Sequence
  Description of Artificial Sequence: Synthetic polynucleotide
  modified_base (72)..(72): a, c, t, g, unknown or other
  modified_base (75)..(75): a, c, t, g, unknown or other
  modified_base (133)..(133): a, c, t, g, unknown or other
  modified_base (139)..(139): a, c, t, g, unknown or other
gataaggctcaattacttgaaatagcyaaarctaatgcagctgccatgtgtgctaaggctggtgtccctttnccnccaaacctaaagcctgcacctccacctactatagwwgagaaagttgctaaaaagtcangagganctactatagaagaactaactgag

SEQ ID NO: 4569 - DNA, 1051 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  misc_feature (640)..(643): This region may encompass 'aata' or is absent in its entirety
  modified_base (683)..(683): a, c, t, g, unknown or other
  modified_base (687)..(687): a, c, t, g, unknown or other
  modified_base (714)..(714): a, c, t, g, unknown or other
  modified_base (728)..(728): a, c, t, g, unknown or other
  modified_base (755)..(755): a, c, t, g, unknown or other
  modified_base (791)..(791): a, c, t, g, unknown or other
  modified_base (994)..(994): a, c, t, g, unknown or other
  modified_base (997)..(997): a, c, t, g, unknown or other
  modified_base (1008)..(1008): a, c, t, g, unknown or other
  modified_base (1026)..(1026): a, c, t, g, unknown or other
  modified_base (1032)..(1032): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacaaatagagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4570 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggytacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4571 - DNA, 818 bp, Artificial Sequence
  Description of Artificial Sequence: Synthetic polynucleotide
  modified_base (67)..(162): a, c, t, g, unknown or other
  modified_base (205)..(205): a, c, t, g, unknown or other
  modified_base (236)..(236): a, c, t, g, unknown or other
  modified_base (240)..(240): a, c, t, g, unknown or other
  modified_base (259)..(259): a, c, t, g, unknown or other
  modified_base (288)..(288): a, c, t, g, unknown or other
  modified_base (294)..(294): a, c, t, g, unknown or other
  modified_base (298)..(298): a, c, t, g, unknown or other
  modified_base (304)..(304): a, c, t, g, unknown or other
  modified_base (322)..(322): a, c, t, g, unknown or other
  modified_base (335)..(335): a, c, t, g, unknown or other
  modified_base (355)..(355): a, c, t, g, unknown or other
  modified_base (366)..(366): a, c, t, g, unknown or other
  modified_base (372)..(372): a, c, t, g, unknown or other
  modified_base (386)..(386): a, c, t, g, unknown or other
  modified_base (451)..(451): a, c, t, g, unknown or other
  modified_base (477)..(477): a, c, t, g, unknown or other
  modified_base (489)..(489): a, c, t, g, unknown or other
  modified_base (499)..(499): a, c, t, g, unknown or other
  modified_base (504)..(504): a, c, t, g, unknown or other
  modified_base (509)..(509): a, c, t, g, unknown or other
  modified_base (521)..(521): a, c, t, g, unknown or other
  modified_base (531)..(531): a, c, t, g, unknown or other
  modified_base (578)..(578): a, c, t, g, unknown or other
  modified_base (614)..(614): a, c, t, g, unknown or other
  modified_base (678)..(678): a, c, t, g, unknown or other
  modified_base (733)..(733): a, c, t, g, unknown or other
  modified_base (739)..(739): a, c, t, g, unknown or other
  misc_feature (759)..(761): This region may encompass 'gtt' or is absent in its entirety
gtccactccctgagctgmgaataaatggaaagcttacacaggaattgaagaatttgaaaacgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaatgtataacattatacagagaggacagtggtaaactnaggactgctgccctttctatatgatgtaatnttanataagacaaacctataacngtctaatggaccactgtttacagtttgancaccantgcnttaccnatatttccttttaactanatctcataaattnatatgaaaaacccttatagncctattccacntaaggngaaggaaaactagnaagcatgaaaaatgaatattaatttaattaaacttttctataatggctcactgtctgttccagantctgaaaastcccaggtaccagaaanctggaaaaaaantagagccagnaaatnggacnaagaaggactcngcttycatantaaaatactcaacatccttgctgtttttaataatgtggaaagttganaatggtggtggtatkgctggtgggtttgtgtgtasntgcatgtggtgtatataattrtatacatataattacttttagagctcttgcatcttgaaaaacncccatctgtttggtaacattttatgttgtggcactttcctcacatttgaaaatgngaattntgatacaaagacrtgtattgtttttttttccacactaagattcagaatgttctggcacagatatttctcattcatgtta

SEQ ID NO: 4572 - DNA, 1996 bp, Artificial Sequence
  Description of Artificial Sequence: Synthetic polynucleotide
  modified_base (8)..(8): a, c, t, g, unknown or other
  modified_base (118)..(118): a, c, t, g, unknown or other
  modified_base (381)..(381): a, c, t, g, unknown or other
  modified_base (412)..(468): a, c, t, g, unknown or other
  modified_base (1246)..(1246): a, c, t, g, unknown or other
  modified_base (1265)..(1265): a, c, t, g, unknown or other
  modified_base (1335)..(1335): a, c, t, g, unknown or other
  modified_base (1386)..(1386): a, c, t, g, unknown or other
  modified_base (1533)..(1533): a, c, t, g, unknown or other
  modified_base (1707)..(1707): a, c, t, g, unknown or other
  modified_base (1709)..(1709): a, c, t, g, unknown or other
  modified_base (1750)..(1750): a, c, t, g, unknown or other
  modified_base (1884)..(1884): a, c, t, g, unknown or other
  modified_base (1974)..(1974): a, c, t, g, unknown or other
ataagccnctgtttataagcatggctcactcttactggctgaagagattgayttctcttgcctgccgctcttcatagcctccataaggaatgtttcaggatgtgattatgctgggganttagacacacataagggragacttttgcagagycctgccatagcatcaaaaaacaagatataacaaaaccaggaggcacmgggactagaatgcaggaggctcatcaccttttgtttcccrgyccagttcccacccaggagtactcaaaactctgcccagattcaaaatgcaaaattaaacagaccatatattaacagttgtatatatattttgcacatgaagaaaatcattatagtattacaattgtgtgtgtatatatatangycataatttttcaaatgcttggaaatgacnnnnnnnnnnnnnnnnnnnnnnnnnnnnnnnnnnnnnnnnnnnnnnnnnnnnnnnnnctatgataggggatgtggcatcttgaaggcctagttgggctgcgtgtgccattaaratatacmgggctgcagaaaagtaaaccccaaatagaatattcctttatcccttgaatgttggaaggataattagatcagatatgatcacgttraattgatcagattggagccagtgctaactcaatcaacttccaattcctaaggcagcagaaagcccagctggagagggaaasttctgctctatctcaccctccctcattcatcctgggagccacaytgtgttctgtagaatttgctcaggattcacaatctgagctgataaacttacctggattatcryaacccttaccattttggtattttctttttgtttctcagtttaaaatgggttgtgaatattactaaygcatcataagttttcagacacccagtatgtcacttgtytgggtccmgtcctaggaaatcaatacctaaattcaaaaartcatcctaagattaatctttgaaagctgcctgtgatgattyggactcactgacctcccttctcttcaacctacagagaaagygaaagagctaccaagtctkagggcacatggacagaaccagaagatgcccagtgaagtgctaggatagggtacagtcccatagctttygggccaaatgagaaggaaaagcagaacctgggaccaggaaagccccagcagctccagactccaggrctctttaccaagactgatgggaggaactaaggcaaagatgagacacctgtcaccaagacacntgtcttggctgcttccacntctgactcagttgtgttgktgtgaatgcaaaactggctctctggctcccaagaatgtataaatccagganagaaaaccaagcatttgggcaccaggcaagaggtctttccagattccccangacttttcagaattccccaaagatactgaaactcagacccattctgaccccaccccaaaaagtatcataaatggaatctgggagccattcagagtctccagcctcctctttggtgaaaatggacttggacctaaaaaggcaccccantgtccacaaggacacaaattcagatgctgagcactggcctcctgccttccgatgacggatcttacctgagtcccatcaaagcccatactgttccccaayctccaccatccagacattaggaacaatccctcagaactgtcttgatgagatgggacaagcagtggtagargtccngnttcagaatggttgcctcatctttcccttctgagaagtctanaccygctggtctgagccttcatcccttacatggcttagcccatgtcccaggaagtgccccctaaaagaaccttctagtatttttctcccctgaagagagggtccatgagacactctatgccaggaaatacatgncctccattctcacatgacttgattgactgataaactgataccctgagaaagaaaaagatgcagggaacatcttgtgtgtggtgaatctgngctcctcagctgtggtgcctgt

SEQ ID NO: 4573 - DNA, 265 bp, Artificial Sequence
  Description of Artificial Sequence: Synthetic polynucleotide
  modified_base (6)..(6): a, c, t, g, unknown or other
  modified_base (95)..(95): a, c, t, g, unknown or other
  modified_base (103)..(103): a, c, t, g, unknown or other
  modified_base (112)..(112): a, c, t, g, unknown or other
  modified_base (160)..(160): a, c, t, g, unknown or other
  modified_base (170)..(170): a, c, t, g, unknown or other
  modified_base (175)..(175): a, c, t, g, unknown or other
  modified_base (207)..(207): a, c, t, g, unknown or other
  modified_base (209)..(209): a, c, t, g, unknown or other
  modified_base (216)..(216): a, c, t, g, unknown or other
  modified_base (240)..(240): a, c, t, g, unknown or other
aaacanctccaccaactggacgaamctataacttgttgacagctttytctctctggttctcagatgaggaaygatgataaaacaaaaccaaaagncrtcttantgaggaagntcagctccagtggatttctytgagacaacccaagttagatggagctangggaaaaaanacagnaattctttaaactatcattcaagcaaaacmtntnrcctaantgttccttttaaagtagctagacntgttagagattttattgagtggata

SEQ ID NO: 4574 - DNA, 263 bp, Artificial Sequence
  Description of Artificial Sequence: Synthetic polynucleotide
  modified_base (10)..(10): a, c, t, g, unknown or other
  modified_base (123)..(123): a, c, t, g, unknown or other
  modified_base (251)..(251): a, c, t, g, unknown or other
cttctcacangccctaaatgtagagcaatctctctgccagtggtcactaggatcacagccctgaggaagctgagggtaacctggtgaatcttctycagtcacattcgggacaggaaccttagnggggttccctgaggagaacagtctcaggaatcctaacctcagccaagacagaggctgggccagatcaatgtcagatagaacctcacaagttttatgtctgacccttctccaccaacaataaagcatgncaatcagtatca

SEQ ID NO: 4575 - DNA, 3127 bp, Artificial Sequence
  Description of Artificial Sequence: Synthetic polynucleotide
  modified_base (15)..(15): a, c, t, g, unknown or other
  modified_base (44)..(44): a, c, t, g, unknown or other
  modified_base (74)..(74): a, c, t, g, unknown or other
  modified_base (96)..(96): a, c, t, g, unknown or other
  modified_base (122)..(122): a, c, t, g, unknown or other
  modified_base (149)..(149): a, c, t, g, unknown or other
  modified_base (188)..(188): a, c, t, g, unknown or other
  modified_base (200)..(200): a, c, t, g, unknown or other
  modified_base (204)..(204): a, c, t, g, unknown or other
  modified_base (207)..(207): a, c, t, g, unknown or other
  modified_base (209)..(209): a, c, t, g, unknown or other
  modified_base (212)..(212): a, c, t, g, unknown or other
  modified_base (214)..(214): a, c, t, g, unknown or other
  modified_base (225)..(225): a, c, t, g, unknown or other
  modified_base (228)..(228): a, c, t, g, unknown or other
  modified_base (246)..(246): a, c, t, g, unknown or other
  modified_base (265)..(265): a, c, t, g, unknown or other
  modified_base (268)..(268): a, c, t, g, unknown or other
  modified_base (270)..(270): a, c, t, g, unknown or other
  modified_base (298)..(298): a, c, t, g, unknown or other
  modified_base (301)..(301): a, c, t, g, unknown or other
  modified_base (309)..(309): a, c, t, g, unknown or other
  modified_base (347)..(347): a, c, t, g, unknown or other
  modified_base (426)..(426): a, c, t, g, unknown or other
  modified_base (436)..(436): a, c, t, g, unknown or other
  modified_base (446)..(446): a, c, t, g, unknown or other
  modified_base (483)..(483): a, c, t, g, unknown or other
  modified_base (514)..(532): a, c, t, g, unknown or other
  modified_base (534)..(535): a, c, t, g, unknown or other
  modified_base (558)..(558): a, c, t, g, unknown or other
  modified_base (574)..(574): a, c, t, g, unknown or other
  modified_base (629)..(629): a, c, t, g, unknown or other
  modified_base (631)..(631): a, c, t, g, unknown or other
  modified_base (645)..(645): a, c, t, g, unknown or other
  modified_base (665)..(665): a, c, t, g, unknown or other
  modified_base (672)..(672): a, c, t, g, unknown or other
  modified_base (712)..(712): a, c, t, g, unknown or other
  modified_base (744)..(744): a, c, t, g, unknown or other
  modified_base (753)..(753): a, c, t, g, unknown or other
  modified_base (772)..(772): a, c, t, g, unknown or other
  modified_base (791)..(791): a, c, t, g, unknown or other
  modified_base (815)..(815): a, c, t, g, unknown or other
  modified_base (845)..(845): a, c, t, g, unknown or other
  modified_base (878)..(878): a, c, t, g, unknown or other
  modified_base (888)..(888): a, c, t, g, unknown or other
  modified_base (892)..(892): a, c, t, g, unknown or other
  modified_base (901)..(901): a, c, t, g, unknown or other
  modified_base (951)..(951): a, c, t, g, unknown or other
  modified_base (956)..(956): a, c, t, g, unknown or other
  modified_base (989)..(989): a, c, t, g, unknown or other
  modified_base (1038)..(1038): a, c, t, g, unknown or other
  modified_base (1063)..(1063): a, c, t, g, unknown or other
  modified_base (1092)..(1092): a, c, t, g, unknown or other
  modified_base (1110)..(1110): a, c, t, g, unknown or other
  modified_base (1112)..(1112): a, c, t, g, unknown or other
  modified_base (1125)..(1125): a, c, t, g, unknown or other
  modified_base (1136)..(1136): a, c, t, g, unknown or other
  modified_base (1163)..(1163): a, c, t, g, unknown or other
  modified_base (1237)..(1237): a, c, t, g, unknown or other
  modified_base (1246)..(1274): a, c, t, g, unknown or other
  modified_base (1343)..(1343): a, c, t, g, unknown or other
  modified_base (1406)..(1406): a, c, t, g, unknown or other
  modified_base (1424)..(1424): a, c, t, g, unknown or other
  modified_base (1429)..(1429): a, c, t, g, unknown or other
  modified_base (1441)..(1441): a, c, t, g, unknown or other
  modified_base (1535)..(1535): a, c, t, g, unknown or other
  modified_base (1562)..(1562): a, c, t, g, unknown or other
  modified_base (1645)..(1645): a, c, t, g, unknown or other
  modified_base (1825)..(1825): a, c, t, g, unknown or other
  modified_base (1842)..(1842): a, c, t, g, unknown or other
  modified_base (1848)..(1848): a, c, t, g, unknown or other
  modified_base (1882)..(1882): a, c, t, g, unknown or other
  modified_base (2056)..(2056): a, c, t, g, unknown or other
  modified_base (2130)..(2130): a, c, t, g, unknown or other
  modified_base (2218)..(2218): a, c, t, g, unknown or other
  modified_base (2223)..(2223): a, c, t, g, unknown or other
  modified_base (2232)..(2232): a, c, t, g, unknown or other
  modified_base (2240)..(2240): a, c, t, g, unknown or other
  modified_base (2311)..(2311): a, c, t, g, unknown or other
  modified_base (2372)..(2372): a, c, t, g, unknown or other
  modified_base (2518)..(2518): a, c, t, g, unknown or other
  modified_base (2547)..(2547): a, c, t, g, unknown or other
  modified_base (2564)..(2564): a, c, t, g, unknown or other
  modified_base (2575)..(2575): a, c, t, g, unknown or other
  modified_base (2623)..(2623): a, c, t, g, unknown or other
  modified_base (2630)..(2630): a, c, t, g, unknown or other
  modified_base (2635)..(2635): a, c, t, g, unknown or other
  modified_base (2673)..(2673): a, c, t, g, unknown or other
  modified_base (2683)..(2683): a, c, t, g, unknown or other
  modified_base (2698)..(2698): a, c, t, g, unknown or other
  modified_base (2747)..(2747): a, c, t, g, unknown or other
  modified_base (2765)..(2765): a, c, t, g, unknown or other
  modified_base (2767)..(2767): a, c, t, g, unknown or other
  modified_base (2793)..(2793): a, c, t, g, unknown or other
  modified_base (2813)..(2813): a, c, t, g, unknown or other
  modified_base (2863)..(2863): a, c, t, g, unknown or other
  modified_base (2867)..(2867): a, c, t, g, unknown or other
  modified_base (2870)..(2870): a, c, t, g, unknown or other
  modified_base (2960)..(2960): a, c, t, g, unknown or other
  modified_base (3007)..(3007): a, c, t, g, unknown or other
  modified_base (3075)..(3075): a, c, t, g, unknown or other
  modified_base (3090)..(3090): a, c, t, g, unknown or other
  modified_base (3120)..(3120): a, c, t, g, unknown or other
  modified_base (3125)..(3125): a, c, t, g, unknown or other
ctcataattttagtntatcttttagctttatgttgccataaacntttcattatatacatgatcaacaacagcanattatctcacctcagtatttanttattttacaaactgatttatgattnctaacatgtaactgaaggtatacactnttagaacacagttttcagtagaaagtagcactgccattnagtaataaaatnttynaanantanancaacattcttntanaagtttgcatgttgtttnctgaggtctaaagcatgantancnacaaaaggctgaataaaattcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaangcattttaaaactttaaatcccttattagcnnnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatnagattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggctttttagtgtnwgattgacnnnnnnnnnnnnnnnnnnnnnnnnnnnnncagaaatactgcayagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaangggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaataganangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4576 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcmtttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4577 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  misc_feature (919)..(919): May or may not be present
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatctttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4578 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (444)..(444): a, c, t, g, unknown or other
  modified_base (478)..(478): a, c, t, g, unknown or other
  modified_base (483)..(483): a, c, t, g, unknown or other
  modified_base (562)..(562): a, c, t, g, unknown or other
  modified_base (656)..(656): a, c, t, g, unknown or other
  modified_base (696)..(696): a, c, t, g, unknown or other
  modified_base (698)..(698): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggnctagccattaaagctgatgtctcttagttgcaancccancctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaaganangtgtctggttgacaatgtctctgacactaccgacagcttcactatgccccaaagccgccagtgccaascacacagtatcccacctccaaagtcaaaatgagagtgggtgcagtggcagccatgacctagatttgttccttagacaccttagtgttctaatttttggn

SEQ ID NO: 4579 - DNA, 387 bp, Artificial Sequence
  Description of Artificial Sequence: Synthetic polynucleotide
  modified_base (7)..(7): a, c, t, g, unknown or other
  modified_base (144)..(144): a, c, t, g, unknown or other
  modified_base (158)..(201): a, c, t, g, unknown or other
ctcggcngaaccagccccggctgggcagcagcggggacgccgggggccggggccagggctttccgggcttmggtgaggccgccgtgggccccatcttccggcggtcgccggagtttgtggtgattgttgctgccgccgccascnccccggctgccatnnnnnnnnnnnnnnnnnnnnnnnnnnnnnnnnnnnnnnnnnnnngggccgggctgatcccctccccgctgccgcctcctcctgggctgggcccgcgktgtctcgtcccctcgcggagccgctcctgccgccgccgccgccgcctcctcattcatcctcgtgcaccataggcggcacaggcaccaagatgtccaaccgagtggtctgccgagaagccagtcacgccgggag

SEQ ID NO: 4580 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatragtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4581 - DNA, 175 bp, Artificial Sequence
  Description of Artificial Sequence: Synthetic polynucleotide
  modified_base (73)..(73): a, c, t, g, unknown or other
  modified_base (85)..(85): a, c, t, g, unknown or other
  modified_base (88)..(88): a, c, t, g, unknown or other
  modified_base (96)..(96): a, c, t, g, unknown or other
  modified_base (133)..(133): a, c, t, g, unknown or other
  modified_base (135)..(135): a, c, t, g, unknown or other
  modified_base (144)..(144): a, c, t, g, unknown or other
ttctttctgaaagtcctttccataggggatcagtgygtaccattcgttcaatcagcttcttccaaagcattcnttctgagatcantcnctgccatnctttacataccagctctgctgcacacagagacctggnanccaggtacnaaagaatgttttctgctatgtgatctaagcc

SEQ ID NO: 4582 - DNA, 673 bp, Artificial Sequence
  Description of Artificial Sequence: Synthetic polynucleotide
  modified_base (14)..(14): a, c, t, g, unknown or other
  modified_base (78)..(78): a, c, t, g, unknown or other
  modified_base (87)..(87): a, c, t, g, unknown or other
  modified_base (110)..(110): a, c, t, g, unknown or other
  modified_base (134)..(134): a, c, t, g, unknown or other
  modified_base (139)..(139): a, c, t, g, unknown or other
  modified_base (164)..(164): a, c, t, g, unknown or other
  modified_base (277)..(277): a, c, t, g, unknown or other
  modified_base (285)..(285): a, c, t, g, unknown or other
  modified_base (297)..(297): a, c, t, g, unknown or other
  modified_base (360)..(360): a, c, t, g, unknown or other
  modified_base (370)..(370): a, c, t, g, unknown or other
  modified_base (442)..(442): a, c, t, g, unknown or other
  modified_base (498)..(498): a, c, t, g, unknown or other
  modified_base (615)..(615): a, c, t, g, unknown or other
  modified_base (672)..(672): a, c, t, g, unknown or other
cgcgactatgctgnctccttcccatccagcaaagctcctgcttcaggccctcagatggactgaccacagtagcaccgncccatcctnctggacccaggatgcacctgccngagcgcctgagtgccctgagccantgcangggstctcccagggctcaccaggcngcactttccttgyagrgctccctgtggattgccatggctgctaggagagcttygyggaggagacgctgacggagaccaactgcaggaacactgtggacttgttgaggaggctngggrctgnccctcggcrccngcatggtgctgggacgcaggaggctcggggctgcccccttggtgcatgmacrgtgctgggacnctgtcagacnctcctgtctttgccccgaagcagaggccaagagaggcacaagggccgcacacctgcctgctcctcttggacncgggtgcccgagcataccctgcaagtgtgcagtctgtcctccaggctgatgcctgnaacacagaccctgtcctgtgccacacccagggctggtctctgaggacctctgtgcagagcyggtgttggccccaggtcccttccctcccagtccaggagctgtagcttgttggcagngggctccatatgcctgagaccaacctgccccctgcacatggatgttgggctgtcacng

SEQ ID NO: 4583 - DNA, 244 bp, Artificial Sequence
  Description of Artificial Sequence: Synthetic polynucleotide
  modified_base (20)..(20): a, c, t, g, unknown or other
  modified_base (25)..(25): a, c, t, g, unknown or other
  modified_base (36)..(36): a, c, t, g, unknown or other
  modified_base (40)..(40): a, c, t, g, unknown or other
  modified_base (64)..(64): a, c, t, g, unknown or other
  modified_base (69)..(69): a, c, t, g, unknown or other
  misc_feature (107)..(108): This region may encompass 'gt' or 'ac'
  modified_base (118)..(118): a, c, t, g, unknown or other
  modified_base (121)..(121): a, c, t, g, unknown or other
  modified_base (136)..(136): a, c, t, g, unknown or other
  modified_base (181)..(181): a, c, t, g, unknown or other
  modified_base (202)..(202): a, c, t, g, unknown or other
  modified_base (211)..(211): a, c, t, g, unknown or other
agactcatcaacttctcatnatcyntactaccacanacancagaatatctaaaacccctagagnccaanccactccagtccatgtttgagttttccaaatccacatrycatttgaagngtngaattttccatgcantgtgttttgaaatcaacagacatatacttaatccttttgcctcantttctgatcatcataaagaynggaaaaacngaaatcctcagttcattttaattctcttagtcc

SEQ ID NO: 4584 - DNA, 174 bp, Artificial Sequence
  Description of Artificial Sequence: Synthetic polynucleotide
  modified_base (6)..(6): a, c, t, g, unknown or other
  modified_base (57)..(57): a, c, t, g, unknown or other
  modified_base (68)..(68): a, c, t, g, unknown or other
  modified_base (73)..(73): a, c, t, g, unknown or other
  modified_base (94)..(94): a, c, t, g, unknown or other
  modified_base (115)..(115): a, c, t, g, unknown or other
  modified_base (119)..(119): a, c, t, g, unknown or other
  modified_base (159)..(159): a, c, t, g, unknown or other
gaggcnggaggggggttggggcttctcagcgccgattccgcgggaagggccctgggncctcacacttnagtcncrggagctgcaggtcttmccnggagagacgctgcacgtggancccncgccgctgcsgttctcagccggctctggagtgcgggcggnggcgacagggccgat

SEQ ID NO: 4585 - DNA, 919 bp, Artificial Sequence
  Description of Artificial Sequence: Synthetic polynucleotide
  modified_base (184)..(184): a, c, t, g, unknown or other
  modified_base (195)..(195): a, c, t, g, unknown or other
  modified_base (276)..(276): a, c, t, g, unknown or other
  modified_base (316)..(316): a, c, t, g, unknown or other
  modified_base (623)..(623): a, c, t, g, unknown or other
  modified_base (679)..(679): a, c, t, g, unknown or other
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaantgacccctggnagagccaggcgcagcacagacagaaagccctgcctgaaagtgactggagccaagagcctgwcactctcggctcattccgtncagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggnctccttggaaccrgctggacatggcggtgacgggacctagtctgcgagtcgagtcntgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4586 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaaycattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4587 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagyggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4588 - DNA, 149 bp, Artificial Sequence
  Description of Artificial Sequence: Synthetic polynucleotide
  modified_base (19)..(19): a, c, t, g, unknown or other
  modified_base (44)..(44): a, c, t, g, unknown or other
  modified_base (67)..(67): a, c, t, g, unknown or other
  modified_base (73)..(73): a, c, t, g, unknown or other
  modified_base (99)..(99): a, c, t, g, unknown or other
  modified_base (108)..(108): a, c, t, g, unknown or other
  modified_base (116)..(116): a, c, t, g, unknown or other
  modified_base (120)..(120): a, c, t, g, unknown or other
tgaaagaacatggtgttgngaaaagaaagagcagttacacaktngaacagttggaacaggtgtttgntcaggnaggatgggatgctcagccctgccagnctgtacttnttaacagnagtngcttgtaccaggagctggagtcagatggc

SEQ ID NO: 4589 - DNA, 1290 bp, Artificial Sequence
  Description of Artificial Sequence: Synthetic polynucleotide
  modified_base (173)..(173): a, c, t, g, unknown or other
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  modified_base (623)..(623): a, c, t, g, unknown or other
  modified_base (862)..(862): a, c, t, g, unknown or other
  modified_base (1049)..(1049): a, c, t, g, unknown or other
  modified_base (1099)..(1099): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcawggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4590 - DNA, 213 bp, Artificial Sequence
  Description of Artificial Sequence: Synthetic polynucleotide
  modified_base (40)..(40): a, c, t, g, unknown or other
  modified_base (52)..(52): a, c, t, g, unknown or other
  modified_base (120)..(120): a, c, t, g, unknown or other
  modified_base (199)..(213): a, c, t, g, unknown or other
ttagcagttgaaaacaaattctacatattatctatgaccntgcacatatgtngtataatktttaagcatgcataggaataatataaaaaaccagtttagacaattgtttacctctaaacnatgaaaagacacaaagccaaatgcttcagaatcacagttttaccaaaatgatcataaagaaatgattacttctcccatnnnnnnnnnnnnnnn

SEQ ID NO: 4591 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttmcatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4592 - DNA, 142 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (48)..(48): a, c, t, g, unknown or other
  modified_base (61)..(61): a, c, t, g, unknown or other
  modified_base (72)..(72): a, c, t, g, unknown or other
  modified_base (79)..(79): a, c, t, g, unknown or other
  modified_base (86)..(86): a, c, t, g, unknown or other
  modified_base (122)..(122): a, c, t, g, unknown or other
  modified_base (126)..(126): a, c, t, g, unknown or other
  modified_base (130)..(130): a, c, t, g, unknown or other
  modified_base (141)..(141): a, c, t, g, unknown or other
ctcctntataggagatancakcagaacataggtttgaagcagtcacantgtgccagaaatnagtttcttcanaactcanagaaganagggaagrcatcatactaaacctctactgagcctcnggtncccnaaactaacagnc

SEQ ID NO: 4593 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagytattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4594 - DNA, 370 bp, Artificial Sequence
  Description of Artificial Sequence: Synthetic polynucleotide
  modified_base (24)..(24): a, c, t, g, unknown or other
  modified_base (103)..(103): a, c, t, g, unknown or other
  modified_base (131)..(131): a, c, t, g, unknown or other
  modified_base (135)..(135): a, c, t, g, unknown or other
  modified_base (175)..(175): a, c, t, g, unknown or other
  modified_base (199)..(199): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (351)..(351): a, c, t, g, unknown or other
taaaagagggaagatgacttttcntaaagygtggaataaagaaaagtaagatagcggatagaagcttgaagtgaaagcaggttcacaggaagtttctttggtntttgttttgtttttaaatagtggaaagntgtntatgtttatggagaaagattgccttgaagatgcaagaggnagagatgatcaaaattcaagaagnagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 4595 - DNA, 150 bp, Artificial Sequence
  Description of Artificial Sequence: Synthetic polynucleotide
  modified_base (52)..(52): a, c, t, g, unknown or other
  modified_base (113)..(113): a, c, t, g, unknown or other
  modified_base (149)..(149): a, c, t, g, unknown or other
ctacatccaggacttctccaccaaatctcagttaattctactgggtaaatangtaaatataaaagaagtcttctatytcaaaacaaaagtggtaaagaagataaaatctaganagccctacttagaaaaccatgagcttatttactacna

SEQ ID NO: 4596 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  modified_base (217)..(217): a, c, t, g, unknown or other
  modified_base (276)..(276): a, c, t, g, unknown or other
  modified_base (322)..(322): a, c, t, g, unknown or other
  modified_base (363)..(363): a, c, t, g, unknown or other
  modified_base (404)..(404): a, c, t, g, unknown or other
  modified_base (406)..(406): a, c, t, g, unknown or other
  modified_base (444)..(444): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaanaaagaaatttaagagatttactccaccaatctcttggtaatttttgtgttcattatcantaagctgtgtgcatccttttagagtgctactgtttgagaaaagcancattgaagttgctgctgatcttggtcatgcattttcagagngtgcttatcagcagacttggatgctgttggggttctstttntnatttgcaatttttccaagacaggctttctgttgcccangctggagtgkgtagctgctgtttctcaatagacaagtcctagaagtagarataattcaattttcattcactcttagctcttctgc

SEQ ID NO: 4597 - DNA, 482 bp, Artificial Sequence
  Description of Artificial Sequence: Synthetic polynucleotide
  modified_base (17)..(17): a, c, t, g, unknown or other
  modified_base (29)..(29): a, c, t, g, unknown or other
  modified_base (42)..(42): a, c, t, g, unknown or other
  modified_base (144)..(144): a, c, t, g, unknown or other
  modified_base (168)..(168): a, c, t, g, unknown or other
  modified_base (190)..(190): a, c, t, g, unknown or other
  modified_base (206)..(206): a, c, t, g, unknown or other
  modified_base (269)..(269): a, c, t, g, unknown or other
  modified_base (281)..(281): a, c, t, g, unknown or other
  modified_base (408)..(408): a, c, t, g, unknown or other
  modified_base (426)..(426): a, c, t, g, unknown or other
  modified_base (437)..(437): a, c, t, g, unknown or other
  modified_base (440)..(440): a, c, t, g, unknown or other
  modified_base (459)..(459): a, c, t, g, unknown or other
  modified_base (461)..(461): a, c, t, g, unknown or other
  modified_base (478)..(478): a, c, t, g, unknown or other
ctttgcatttccagccnttggttggtacngatttcataaytngttgaagacaaaaagtatgataccctttgtcacacgtatcacacactagcatcttgctatcttctcccgattgtctaaaaartaagatagcattaatgatgncttatctttaaacttatgttttgnaacataagtaatcatgaaaatnatcagtcctgggaacngcacagttcataaatacctcagtatctgttttgtctctgcagatagtaacagaggtaaccctnccataaggattncctcctaaatggtgatctttactcaatgctcacctatggttaacttgctctagccattttaggattcctgcaaaggaggaagggttaaggcaagatgaatagcctctgatctttacttttaaaatanaatttttgagaggaaggngctataactgntangtgctactgtgtggaaagnancaaatcttggcacagcnaatt

SEQ ID NO: 4598 - DNA, 327 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (33)..(33): a, c, t, g, unknown or other
  modified_base (45)..(45): a, c, t, g, unknown or other
  modified_base (53)..(53): a, c, t, g, unknown or other
  modified_base (58)..(58): a, c, t, g, unknown or other
  modified_base (70)..(70): a, c, t, g, unknown or other
  modified_base (81)..(81): a, c, t, g, unknown or other
  modified_base (123)..(123): a, c, t, g, unknown or other
  modified_base (126)..(126): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (151)..(151): a, c, t, g, unknown or other
  modified_base (159)..(159): a, c, t, g, unknown or other
  modified_base (165)..(165): a, c, t, g, unknown or other
  modified_base (168)..(168): a, c, t, g, unknown or other
  modified_base (203)..(203): a, c, t, g, unknown or other
  modified_base (208)..(208): a, c, t, g, unknown or other
  modified_base (210)..(210): a, c, t, g, unknown or other
  modified_base (212)..(212): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (282)..(282): a, c, t, g, unknown or other
  modified_base (292)..(292): a, c, t, g, unknown or other
  modified_base (294)..(294): a, c, t, g, unknown or other
  modified_base (301)..(301): a, c, t, g, unknown or other
  modified_base (321)..(321): a, c, t, g, unknown or other
cactttggcattgtgatttaaaatgtnctncangatgggataatnatatgttnacaanggatataagganagtagacaggnatggtattcttacagccatgttcccaccagggtcaagagaanagnacaaagccnagncangccagggccnttccaaangggccncantkcccctctggaggctgctgacctggagacctgcnatggncncntcttgccagctctccttcctctttctccagangncngcccagccttgctagctatatwttacacccaacngagcagagcnanactgganaataatcaaatgtttccccnttttaa

SEQ ID NO: 4599 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtrtagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4600 - DNA, 327 bp, Artificial Sequence
  Description of Artificial Sequence: Synthetic polynucleotide
  modified_base (35)..(35): a, c, t, g, unknown or other
  modified_base (121)..(121): a, c, t, g, unknown or other
  modified_base (195)..(195): a, c, t, g, unknown or other
  modified_base (254)..(254): a, c, t, g, unknown or other
gaatcatatgttgtccatcccccyctcaggcttgnaagtcctcaaagagacccactatcccatatcactgcccagagggatgatgggagatgcagccttgatcatgtgacttccagcatgntcacctactgccttctgagtagaagaactcactgcagagcagtttacctcattktaccttagttgcatgtgatngcaatgtttgagttattacttgcagagataggagcaaaaattacaaaaayacacagggnagtgggtccttttgtggytttcctagttactcaaattgactttcccccacctttgcacaggtgctttcaatag

SEQ ID NO: 4601 - DNA, 102 bp, Artificial Sequence
  Description of Artificial Sequence: Synthetic polynucleotide
  modified_base (83)..(83): a, c, t, g, unknown or other
actgtgattgtaaaaattatagcaaaacatcagaccytcttattatttacctcccctctttctttggaggtggtcaatctgtnatatataccataaattttt

SEQ ID NO: 4602 - DNA, 744 bp, Artificial Sequence
  Description of Artificial Sequence: Synthetic polynucleotide
  modified_base (58)..(58): a, c, t, g, unknown or other
  modified_base (261)..(261): a, c, t, g, unknown or other
  modified_base (286)..(286): a, c, t, g, unknown or other
  modified_base (347)..(347): a, c, t, g, unknown or other
  modified_base (356)..(356): a, c, t, g, unknown or other
  modified_base (486)..(486): a, c, t, g, unknown or other
  modified_base (641)..(641): a, c, t, g, unknown or other
  modified_base (726)..(726): a, c, t, g, unknown or other
  modified_base (743)..(743): a, c, t, g, unknown or other
ttcagcaaactccttacgttttgtgtcagaagaaagacatcactggggcctggtctanaaggagactccaggtgtctgagggaagtgaggctttgttctgcacacaggcttgtcgtcaccctgtgcgttgtcctgtaattccaggtctcctcctactgtgagatggaacgagagcttagagtgaaggagctctgagaacctattccctcccctgaccctgctgccagcccctacatgcttctaacccactcctgaacatanccactaaaaattgatctggctacantcctcccacgacaaagttttaccytcagkaattgtgctcacaacagctttcctcctagagntttctgccnagaacatacacaggtgcctagaagactcctggcttatctmaactgtagacamtgaatctctatcgggaacctgtttttttcaccaacccaggtttcttggactacctgatcataatctcttctgattgtntgaacacaggaataagtcagaacatagcgctgcctgagcctgtatctgtagcacaaaccagttccttaaccaattctgccctgcatccccacccatagttcttgatagcatctttctcttttctgcttttttcttccccacaaatcctctttcangtgtacacagtgtgcccaaggccatccctccagtgcctgaatccagtgcctactagaagtcagatgttaatgagttcaagaccangcctttagacccggctnt

SEQ ID NO: 4603 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagytttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4604 - DNA, 275 bp, Artificial Sequence
  Description of Artificial Sequence: Synthetic polynucleotide
  modified_base (6)..(6): a, c, t, g, unknown or other
  modified_base (14)..(14): a, c, t, g, unknown or other
  modified_base (237)..(237): a, c, t, g, unknown or other
  modified_base (274)..(274): a, c, t, g, unknown or other
cttccngtggatantagtatcataaaacaatttatattatttaaccagttatagactcactgttggcatgttacatttaacacacacttgacttttgatttgaaatcatttcctcattaaatcctgtatctcacctttgagattaatgtgataatgtgatgtagcctctattgatgcctcagagagtgagaaygtgatgtaacctttagtgaagcctcacactgtttattaagatcngccaattttttttgaagttgtctcacaatgacctgana

SEQ ID NO: 4605 - DNA, 91 bp, Artificial Sequence
  Description of Artificial Sequence: Synthetic oligonucleotide
  modified_base (18)..(18): a, c, t, g, unknown or other
  modified_base (40)..(40): a, c, t, g, unknown or other
aaaatcaacsgcttcagnagaactggtaccagctagaaancctctccaacctcctcaagkccatggtcagctacagcatgaaccccgtgga

SEQ ID NO: 4606 - DNA, 374 bp, Artificial Sequence
  Description of Artificial Sequence: Synthetic polynucleotide
  modified_base (16)..(16): a, c, t, g, unknown or other
  modified_base (22)..(22): a, c, t, g, unknown or other
  modified_base (47)..(47): a, c, t, g, unknown or other
  modified_base (72)..(72): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (145)..(145): a, c, t, g, unknown or other
  modified_base (148)..(148): a, c, t, g, unknown or other
  modified_base (153)..(153): a, c, t, g, unknown or other
  modified_base (156)..(156): a, c, t, g, unknown or other
  modified_base (176)..(176): a, c, t, g, unknown or other
  modified_base (193)..(193): a, c, t, g, unknown or other
  modified_base (234)..(234): a, c, t, g, unknown or other
  modified_base (276)..(276): a, c, t, g, unknown or other
  modified_base (309)..(309): a, c, t, g, unknown or other
  modified_base (321)..(321): a, c, t, g, unknown or other
  modified_base (326)..(326): a, c, t, g, unknown or other
  modified_base (334)..(334): a, c, t, g, unknown or other
  modified_base (349)..(349): a, c, t, g, unknown or other
  modified_base (354)..(354): a, c, t, g, unknown or other
  modified_base (363)..(363): a, c, t, g, unknown or other
caaagtttatatcaanaaaagnggtaaatatttaaaaactgagtttntcaagtagtgtctccctttcattcnccttgcagataaactttcaaacyntngaatatttctccacnacctgaagaatcaggatcaagctctcaaaatnccnagtgngtntttctgacaggtcgtagggntgayctcttgaacatgnccaagatkttttggttgctcatcctatcatgatgtcctgwncatctttcagaaatggaacccatattgatggattcaatgtangcaaaattccactatctaccagatagctgtgcnttcttcattttncaggnagaaacanggttgtagattagantatgntacagcaantattcacctcc

SEQ ID NO: 4607 - DNA, 828 bp, Artificial Sequence
  Description of Artificial Sequence: Synthetic polynucleotide
  modified_base (4)..(4): a, c, t, g, unknown or other
  modified_base (13)..(13): a, c, t, g, unknown or other
  modified_base (18)..(18): a, c, t, g, unknown or other
  modified_base (21)..(21): a, c, t, g, unknown or other
  modified_base (53)..(53): a, c, t, g, unknown or other
  modified_base (67)..(67): a, c, t, g, unknown or other
  modified_base (69)..(69): a, c, t, g, unknown or other
  modified_base (86)..(86): a, c, t, g, unknown or other
  modified_base (95)..(95): a, c, t, g, unknown or other
  modified_base (117)..(117): a, c, t, g, unknown or other
  modified_base (120)..(120): a, c, t, g, unknown or other
  modified_base (130)..(130): a, c, t, g, unknown or other
  modified_base (144)..(144): a, c, t, g, unknown or other
  modified_base (184)..(184): a, c, t, g, unknown or other
  modified_base (207)..(207): a, c, t, g, unknown or other
  modified_base (211)..(211): a, c, t, g, unknown or other
  modified_base (223)..(223): a, c, t, g, unknown or other
  modified_base (228)..(228): a, c, t, g, unknown or other
  modified_base (231)..(231): a, c, t, g, unknown or other
  modified_base (257)..(257): a, c, t, g, unknown or other
  modified_base (279)..(279): a, c, t, g, unknown or other
  modified_base (284)..(284): a, c, t, g, unknown or other
  modified_base (292)..(292): a, c, t, g, unknown or other
  modified_base (313)..(313): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (338)..(338): a, c, t, g, unknown or other
  modified_base (372)..(493): a, c, t, g, unknown or other
  modified_base (499)..(499): a, c, t, g, unknown or other
  modified_base (521)..(521): a, c, t, g, unknown or other
  modified_base (549)..(549): a, c, t, g, unknown or other
  modified_base (557)..(557): a, c, t, g, unknown or other
  modified_base (565)..(565): a, c, t, g, unknown or other
  modified_base (569)..(591): a, c, t, g, unknown or other
  modified_base (593)..(593): a, c, t, g, unknown or other
  modified_base (610)..(610): a, c, t, g, unknown or other
  modified_base (650)..(650): a, c, t, g, unknown or other
  modified_base (686)..(686): a, c, t, g, unknown or other
  modified_base (720)..(720): a, c, t, g, unknown or other
  modified_base (764)..(764): a, c, t, g, unknown or other
  modified_base (786)..(786): a, c, t, g, unknown or other
  modified_base (788)..(788): a, c, t, g, unknown or other
  modified_base (803)..(803): a, c, t, g, unknown or other
  modified_base (805)..(805): a, c, t, g, unknown or other
  modified_base (821)..(821): a, c, t, g, unknown or other
tatncatgtgtantgcanacnttctttcttcctttctcatccttgcagtcgcnttctcttccttttncntctttcattccrtttangtgtcaaanaccacargtctgggaaaggaanaanatgtaagagnaagatgcctactangtgggcacatagagagctcctggtgggacagggactgcanagaagagccactgcttggagagntttntcaaaaactctnccttnatntaaatgaatttcaacagcaaagtgangacatatccacacatttaaatnaaatncttccccntttccctggcakttaatatangaaatantntancatgtttatcaanggaaaacaccaccaaagacctgctttttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatngtcataattggtcctgtctaanatgagagccatggggaatgcccaattanattggytngtttcctnccannnnnnnnnnnnnnnnnnnnnnntntcctgatgaggtggttntccagatacttgtatctggtatccagattttctctgcttntccacagcaagaaatgatgtagggcatctctaggcngtcttttgcccctaatccagactcatgggtctcngggattaagggtcctccaccaattcrtaagaccttcacctattntccttgttaccatcatcacaananttctgtttctgattncncctgctcctctcccanattttta

SEQ ID NO: 4608 - DNA, 119 bp, Artificial Sequence
  Description of Artificial Sequence: Synthetic polynucleotide
  modified_base (2)..(2): a, c, t, g, unknown or other
  modified_base (48)..(48): a, c, t, g, unknown or other
  modified_base (51)..(51): a, c, t, g, unknown or other
  modified_base (55)..(55): a, c, t, g, unknown or other
  modified_base (64)..(64): a, c, t, g, unknown or other
  modified_base (73)..(73): a, c, t, g, unknown or other
  modified_base (81)..(81): a, c, t, g, unknown or other
  modified_base (84)..(84): a, c, t, g, unknown or other
  modified_base (111)..(111): a, c, t, g, unknown or other
angattgcaatagaattggccaacatctcaacagagttacakgattgncanattntctgaattncctcaayanagagccantantctgagtctgggaatgctaaatgaaanccatgcct

SEQ ID NO: 4609 - DNA, 114 bp, Artificial Sequence
  Description of Artificial Sequence: Synthetic polynucleotide
  modified_base (63)..(63): a, c, t, g, unknown or other
  modified_base (78)..(78): a, c, t, g, unknown or other
  modified_base (90)..(90): a, c, t, g, unknown or other
gaatatgaactaagaaaaactaaagtctaacaggggaaaygtgtcagaaaaaaataccaatgnaggtttttgaatatntgaaggaaaaantgattaaattatgcagatgaaata

SEQ ID NO: 4610 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccrtttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4611 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacrgcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4612 - DNA, 224 bp, Artificial Sequence
  Description of Artificial Sequence: Synthetic polynucleotide
  modified_base (28)..(28): a, c, t, g, unknown or other
  modified_base (83)..(83): a, c, t, g, unknown or other
  modified_base (117)..(117): a, c, t, g, unknown or other
  modified_base (120)..(120): a, c, t, g, unknown or other
  modified_base (124)..(124): a, c, t, g, unknown or other
  modified_base (138)..(138): a, c, t, g, unknown or other
  modified_base (143)..(143): a, c, t, g, unknown or other
  modified_base (160)..(160): a, c, t, g, unknown or other
  modified_base (166)..(166): a, c, t, g, unknown or other
  modified_base (174)..(174): a, c, t, g, unknown or other
  modified_base (181)..(181): a, c, t, g, unknown or other
  modified_base (191)..(191): a, c, t, g, unknown or other
  modified_base (195)..(195): a, c, t, g, unknown or other
  modified_base (199)..(199): a, c, t, g, unknown or other
  modified_base (212)..(212): a, c, t, g, unknown or other
gtactcaaatcaaattggcttacttgcntatattyttgtttttcatggatgttggccccttaagtcctagttgcctcagcaantctctagagcatttacatatgaatatgtgtatanatntatnaagaattgtggtantttanatgctgtaagctacccnatcctngtcaaaanatggggntataaatagntatnaaantatataggtgatnccatgcattgtt

SEQ ID NO: 4613 - DNA, 1744 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  misc_feature (635)..(637): This region may encompass 'aac' or is absent in its entirety
  modified_base (730)..(730): a, c, t, g, unknown or other
  modified_base (734)..(734): a, c, t, g, unknown or other
  modified_base (744)..(744): a, c, t, g, unknown or other
  modified_base (758)..(758): a, c, t, g, unknown or other
  modified_base (779)..(779): a, c, t, g, unknown or other
  modified_base (797)..(797): a, c, t, g, unknown or other
  modified_base (839)..(839): a, c, t, g, unknown or other
  modified_base (850)..(850): a, c, t, g, unknown or other
  modified_base (889)..(889): a, c, t, g, unknown or other
  modified_base (900)..(900): a, c, t, g, unknown or other
  modified_base (909)..(909): a, c, t, g, unknown or other
  modified_base (914)..(914): a, c, t, g, unknown or other
  modified_base (958)..(958): a, c, t, g, unknown or other
  modified_base (960)..(960): a, c, t, g, unknown or other
  modified_base (983)..(983): a, c, t, g, unknown or other
  modified_base (1079)..(1079): a, c, t, g, unknown or other
  modified_base (1155)..(1155): a, c, t, g, unknown or other
  modified_base (1262)..(1262): a, c, t, g, unknown or other
  modified_base (1266)..(1266): a, c, t, g, unknown or other
  modified_base (1361)..(1361): a, c, t, g, unknown or other
  modified_base (1366)..(1366): a, c, t, g, unknown or other
  modified_base (1375)..(1375): a, c, t, g, unknown or other
  modified_base (1383)..(1383): a, c, t, g, unknown or other
  modified_base (1387)..(1387): a, c, t, g, unknown or other
  modified_base (1390)..(1390): a, c, t, g, unknown or other
  modified_base (1392)..(1392): a, c, t, g, unknown or other
  modified_base (1396)..(1396): a, c, t, g, unknown or other
  modified_base (1448)..(1448): a, c, t, g, unknown or other
  modified_base (1466)..(1466): a, c, t, g, unknown or other
  modified_base (1472)..(1472): a, c, t, g, unknown or other
  modified_base (1501)..(1501): a, c, t, g, unknown or other
  modified_base (1517)..(1517): a, c, t, g, unknown or other
  modified_base (1536)..(1536): a, c, t, g, unknown or other
  modified_base (1538)..(1538): a, c, t, g, unknown or other
  modified_base (1594)..(1594): a, c, t, g, unknown or other
  modified_base (1699)..(1699): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacaacttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4614 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatytttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4615 - DNA, 324 bp, Artificial Sequence
  Description of Artificial Sequence: Synthetic polynucleotide
  modified_base (22)..(22): a, c, t, g, unknown or other
  modified_base (32)..(32): a, c, t, g, unknown or other
  modified_base (34)..(34): a, c, t, g, unknown or other
  modified_base (41)..(41): a, c, t, g, unknown or other
  modified_base (47)..(47): a, c, t, g, unknown or other
  misc_feature (49)..(51): This region may encompass 'gtg' or is absent in its entirety
  modified_base (77)..(77): a, c, t, g, unknown or other
  modified_base (82)..(82): a, c, t, g, unknown or other
  modified_base (136)..(136): a, c, t, g, unknown or other
  modified_base (144)..(144): a, c, t, g, unknown or other
  modified_base (148)..(148): a, c, t, g, unknown or other
  modified_base (152)..(152): a, c, t, g, unknown or other
  modified_base (173)..(173): a, c, t, g, unknown or other
  modified_base (178)..(178): a, c, t, g, unknown or other
  modified_base (192)..(192): a, c, t, g, unknown or other
  modified_base (201)..(201): a, c, t, g, unknown or other
  modified_base (204)..(204): a, c, t, g, unknown or other
  modified_base (254)..(254): a, c, t, g, unknown or other
  modified_base (259)..(259): a, c, t, g, unknown or other
  modified_base (276)..(276): a, c, t, g, unknown or other
  modified_base (288)..(288): a, c, t, g, unknown or other
  modified_base (300)..(300): a, c, t, g, unknown or other
ctatagaaattactggactaanatgtgtgttngnttttttntttgtntgtgttttcactcagaatgattccttccwnggggnttctgagtctcctccctaccccattgtctagccctttaaatacatttgacaatnaagttctntctnttcnccagacatatttggacatgtngaatnccagcaagagaagnagtttgttnttncccctgaaggcttccagctgtgtgcaagcagacttccacagatgccacancatcncttagcagatgtgttcngatatttctaantccacctaattnaagctgaaaattctcaattgtgtt

SEQ ID NO: 4616 - DNA, 272 bp, Artificial Sequence
  Description of Artificial Sequence: Synthetic polynucleotide
  modified_base (103)..(103): a, c, t, g, unknown or other
  modified_base (114)..(114): a, c, t, g, unknown or other
  modified_base (122)..(122): a, c, t, g, unknown or other
  modified_base (134)..(134): a, c, t, g, unknown or other
  modified_base (159)..(159): a, c, t, g, unknown or other
  modified_base (175)..(175): a, c, t, g, unknown or other
  modified_base (205)..(205): a, c, t, g, unknown or other
  modified_base (259)..(259): a, c, t, g, unknown or other
gggacacaagtgcaggttcagggcaaggtgtgygagcacactcagtccctggcctcggagtctctctggatggcttcttgcctagggtgactgacagaggganggatgatatgnaaaggcanctgttctcctcngacctaaccccaattcttactccangggttcatgacagccnattctgctggagactgtgtcttaaaacttnctcccctagtttctctcaagtacccctcgtgagctgtgatttcactgggctttnaactcttaggcca

SEQ ID NO: 4617 - DNA, 100 bp, Artificial Sequence
  Description of Artificial Sequence: Synthetic polynucleotide
  modified_base (58)..(58): a, c, t, g, unknown or other
actagtttacctctgatgagcatcagctaatatttaatcyattgtgaaattacacagnatcaaaataaaatataatacagttagttaaaatagaaaaatt

SEQ ID NO: 4618 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgrcacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4619 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatwcgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4620 - DNA, 150 bp, Artificial Sequence
  Description of Artificial Sequence: Synthetic polynucleotide
  modified_base (25)..(25): a, c, t, g, unknown or other
  modified_base (28)..(28): a, c, t, g, unknown or other
  modified_base (30)..(30): a, c, t, g, unknown or other
  modified_base (35)..(35): a, c, t, g, unknown or other
  modified_base (55)..(55): a, c, t, g, unknown or other
  modified_base (57)..(57): a, c, t, g, unknown or other
  modified_base (61)..(61): a, c, t, g, unknown or other
  modified_base (66)..(66): a, c, t, g, unknown or other
  modified_base (89)..(89): a, c, t, g, unknown or other
  modified_base (126)..(126): a, c, t, g, unknown or other
  modified_base (141)..(141): a, c, t, g, unknown or other
  modified_base (143)..(143): a, c, t, g, unknown or other
tgtttgttaattggcttccactggnacnangaatntcaaacactttcacaatgtnanatgntcaantcttctaataattttgatttcangtagagcatktttgacactctggggatcagtaagganaattttcttgatggntnctctttt

SEQ ID NO: 4621 - DNA, 100 bp, Artificial Sequence
  Description of Artificial Sequence: Synthetic polynucleotide
  modified_base (93)..(93): a, c, t, g, unknown or other
ttcagaataaatgaaaatatagattattgaatctgacaataaatcatattmtttataaatgaaagcagaatggaagattaatttggattcagntattaag

SEQ ID NO: 4622 - DNA, 92 bp, Artificial Sequence
  Description of Artificial Sequence: Synthetic oligonucleotide
  modified_base (21)..(21): a, c, t, g, unknown or other
gcactgatccaccactagccnatgactyctttagagatcttgtctttgggtatttccagatactgtcctatacagtaacagatacattaaaa

SEQ ID NO: 4623 - DNA, 642 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (138)..(138): a, c, t, g, unknown or other
  modified_base (219)..(219): a, c, t, g, unknown or other
  modified_base (296)..(296): a, c, t, g, unknown or other
  modified_base (300)..(300): a, c, t, g, unknown or other
  modified_base (314)..(314): a, c, t, g, unknown or other
  modified_base (323)..(323): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcatttncttgcaaatagcctaccctttctcttacacgtcctttgacacattttagatggtttngccatacaaaacntttcnattttnagttaaangtaggctnagnaaacatttcaagaaactgaagtgtttcttttttcacctgcttttaatctaaagtcttattatatctggattttaacatttnttaaaagtaatgtcagattataaatgtttggattttattcattttctaaatgattctgactggtttcctacatatanaatnatgaccygcaaaanaagatgtgncctttactttctaattatttgcaactaatctgtactggtttatacatctaggaaactgatgagcaactggtgggagtgtgtatctttttcatatgaagcatgcttctagtggtttactattagacaataatgggttggcmtttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4624 - DNA, 460 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (37)..(37): a, c, t, g, unknown or other
  modified_base (57)..(57): a, c, t, g, unknown or other
  modified_base (69)..(69): a, c, t, g, unknown or other
  modified_base (72)..(72): a, c, t, g, unknown or other
  modified_base (117)..(117): a, c, t, g, unknown or other
  modified_base (146)..(146): a, c, t, g, unknown or other
  modified_base (157)..(157): a, c, t, g, unknown or other
  modified_base (167)..(167): a, c, t, g, unknown or other
  modified_base (174)..(174): a, c, t, g, unknown or other
  modified_base (191)..(191): a, c, t, g, unknown or other
  modified_base (201)..(201): a, c, t, g, unknown or other
  modified_base (212)..(212): a, c, t, g, unknown or other
  modified_base (225)..(225): a, c, t, g, unknown or other
  modified_base (231)..(231): a, c, t, g, unknown or other
  modified_base (243)..(243): a, c, t, g, unknown or other
  modified_base (284)..(284): a, c, t, g, unknown or other
  modified_base (297)..(297): a, c, t, g, unknown or other
  modified_base (300)..(300): a, c, t, g, unknown or other
  modified_base (302)..(302): a, c, t, g, unknown or other
  modified_base (305)..(305): a, c, t, g, unknown or other
  modified_base (308)..(308): a, c, t, g, unknown or other
  modified_base (313)..(313): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (342)..(342): a, c, t, g, unknown or other
  modified_base (347)..(347): a, c, t, g, unknown or other
  modified_base (371)..(371): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (422)..(422): a, c, t, g, unknown or other
  modified_base (443)..(443): a, c, t, g, unknown or other
  modified_base (453)..(453): a, c, t, g, unknown or other
tccttcactttgaagrtgtcagctnccagnacataangacaaagagaaaacctcagngtcatgtttaancantctgatttatactgaggacaaattaaagaaagtaatttatrtaangaagagtaaacttatggaactcattgccnaaagaggaggnacagacrtanaaatatncaaagacatctacgagnaattgttcanacmtttattgnacagcagcctaanagaacntggagcacgatnaygtttggagtcaccctgaggttsacatcacagcacacaanagctttttgcccnacngncantgngcccnagtgntttctgaggacnggaatngggagntgganggacctgcaggtcctccccatggnacaaacgctgcaccttgcacacacctgggtccctgcnatgtcnagcccnancctgtgcacagtgaggagagnacacctggtnatcagga

SEQ ID NO: 4625 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  misc_feature (54)..(54): May or may not be present
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctgggtggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4626 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctktgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4627 - DNA, 354 bp, Artificial Sequence
  Description of Artificial Sequence: Synthetic polynucleotide
  modified_base (49)..(49): a, c, t, g, unknown or other
  modified_base (57)..(57): a, c, t, g, unknown or other
  modified_base (63)..(63): a, c, t, g, unknown or other
  modified_base (89)..(89): a, c, t, g, unknown or other
  modified_base (119)..(119): a, c, t, g, unknown or other
  modified_base (126)..(126): a, c, t, g, unknown or other
  modified_base (128)..(128): a, c, t, g, unknown or other
  modified_base (158)..(158): a, c, t, g, unknown or other
  modified_base (166)..(166): a, c, t, g, unknown or other
  modified_base (176)..(176): a, c, t, g, unknown or other
  modified_base (207)..(207): a, c, t, g, unknown or other
  modified_base (211)..(211): a, c, t, g, unknown or other
  modified_base (213)..(213): a, c, t, g, unknown or other
  modified_base (236)..(351): a, c, t, g, unknown or other
ccctctcaaatcattctagtctggtttaccaaacagaaccacyagctangaggatanaaatanttcccrtgttcactagccattaaatnaacatagccacttgtgcaggaagcctaacntttttananttcctaactttttaaaacttaaggataagnccatttcnacaagctaantttacagctccttaatattcttmatctggangttnantttgcagactttgttggtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnata

SEQ ID NO: 4628 - DNA, 1351 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  misc_feature (533)..(534): This region may encompass 'at' or is absent in its entirety
  modified_base (560)..(560): a, c, t, g, unknown or other
  modified_base (590)..(590): a, c, t, g, unknown or other
  modified_base (610)..(610): a, c, t, g, unknown or other
  modified_base (703)..(703): a, c, t, g, unknown or other
  modified_base (707)..(707): a, c, t, g, unknown or other
  modified_base (729)..(729): a, c, t, g, unknown or other
  modified_base (732)..(732): a, c, t, g, unknown or other
  modified_base (745)..(745): a, c, t, g, unknown or other
  modified_base (771)..(771): a, c, t, g, unknown or other
  modified_base (789)..(789): a, c, t, g, unknown or other
  modified_base (882)..(882): a, c, t, g, unknown or other
  modified_base (947)..(947): a, c, t, g, unknown or other
  modified_base (957)..(957): a, c, t, g, unknown or other
  modified_base (1021)..(1021): a, c, t, g, unknown or other
  modified_base (1030)..(1030): a, c, t, g, unknown or other
  modified_base (1070)..(1070): a, c, t, g, unknown or other
  modified_base (1110)..(1110): a, c, t, g, unknown or other
  modified_base (1148)..(1148): a, c, t, g, unknown or other
  modified_base (1152)..(1152): a, c, t, g, unknown or other
  modified_base (1250)..(1288): a, c, t, g, unknown or other
  modified_base (1333)..(1333): a, c, t, g, unknown or other
  modified_base (1337)..(1337): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctatggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4629 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaamtttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4630 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcrtcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4631 - DNA, 346 bp, Artificial Sequence
  Description of Artificial Sequence: Synthetic polynucleotide
  modified_base (12)..(12): a, c, t, g, unknown or other
  modified_base (29)..(29): a, c, t, g, unknown or other
  modified_base (46)..(46): a, c, t, g, unknown or other
  modified_base (87)..(87): a, c, t, g, unknown or other
  modified_base (89)..(89): a, c, t, g, unknown or other
  modified_base (119)..(119): a, c, t, g, unknown or other
  modified_base (177)..(177): a, c, t, g, unknown or other
  modified_base (187)..(187): a, c, t, g, unknown or other
  modified_base (218)..(218): a, c, t, g, unknown or other
  modified_base (222)..(222): a, c, t, g, unknown or other
  modified_base (237)..(237): a, c, t, g, unknown or other
  modified_base (255)..(255): a, c, t, g, unknown or other
  modified_base (258)..(258): a, c, t, g, unknown or other
  modified_base (281)..(281): a, c, t, g, unknown or other
  modified_base (303)..(303): a, c, t, g, unknown or other
  modified_base (309)..(309): a, c, t, g, unknown or other
  modified_base (311)..(311): a, c, t, g, unknown or other
cataaagcagtntatttttcttaaaaagnaaggtacatggtcacantccaaaatgttttatacagctctcagcytggaaaatgcaantnatgaaaaaggcactgtttctagaacaratngaaaaagaataaatatgtcaycatttaccctgcacagctttgagtaacaccataggancctgtcacangttcagggtcaattttaaaagcttgagaagnacanagcaaggtgatgtcntagactagccaggctccnaanggaagagctgtctgtccctcctnmactgtcctctctctgtcacangtgtcntntcactgttcctctagcagatgtggaaagtggctgc

SEQ ID NO: 4632 - DNA, 102 bp, Artificial Sequence
  Description of Artificial Sequence: Synthetic polynucleotide
  modified_base (26)..(26): a, c, t, g, unknown or other
  misc_feature (37)..(37): May or may not be present
  modified_base (67)..(67): a, c, t, g, unknown or other
aacctgttcagtgctgccagtcaacngagcgtctgttgagtagcagcgtgggatcaggcagcagggnttttttttccccgttgctttcgttcctttgcagga

SEQ ID NO: 4633 - DNA, 223 bp, Artificial Sequence
  Description of Artificial Sequence: Synthetic polynucleotide
  modified_base (4)..(4): a, c, t, g, unknown or other
  modified_base (23)..(23): a, c, t, g, unknown or other
  modified_base (29)..(29): a, c, t, g, unknown or other
  modified_base (34)..(34): a, c, t, g, unknown or other
  modified_base (36)..(36): a, c, t, g, unknown or other
  modified_base (53)..(53): a, c, t, g, unknown or other
  modified_base (68)..(68): a, c, t, g, unknown or other
  modified_base (87)..(87): a, c, t, g, unknown or other
  modified_base (96)..(96): a, c, t, g, unknown or other
  modified_base (98)..(98): a, c, t, g, unknown or other
  modified_base (104)..(104): a, c, t, g, unknown or other
  misc_feature (134)..(136): This region may encompass 'aaa' or is absent in its entirety
  modified_base (151)..(151): a, c, t, g, unknown or other
  modified_base (165)..(165): a, c, t, g, unknown or other
  modified_base (187)..(187): a, c, t, g, unknown or other
  modified_base (191)..(191): a, c, t, g, unknown or other
  modified_base (198)..(198): a, c, t, g, unknown or other
  modified_base (205)..(205): a, c, t, g, unknown or other
  modified_base (221)..(221): a, c, t, g, unknown or other
tatnctctaaatttggccaaacnaagtanttgananaaaaatcctggcaaagngcagsggtccctgcnggactgtgtggcaaacccngacattctntngccttngcagataagtcaaaacaaggacaatctaaaaagaggccattccctcnccaattagcaattnaagggttagaactgaaatagwngcanaggaaanagacacntacatactcaaacacncc

SEQ ID NO: 4634 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttmacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4635 - DNA, 84 bp, Artificial Sequence
  Description of Artificial Sequence: Synthetic oligonucleotide
tgtttttaaaatctttatatagcttggtatcctttytcctttccttccttttactcttttatgagttttatcttagactaacct

SEQ ID NO: 4636 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactrtttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4637 - DNA, 442 bp, Artificial Sequence
  Description of Artificial Sequence: Synthetic polynucleotide
  modified_base (10)..(10): a, c, t, g, unknown or other
  modified_base (49)..(49): a, c, t, g, unknown or other
  modified_base (52)..(52): a, c, t, g, unknown or other
  modified_base (75)..(75): a, c, t, g, unknown or other
  modified_base (79)..(79): a, c, t, g, unknown or other
  modified_base (102)..(102): a, c, t, g, unknown or other
  modified_base (134)..(134): a, c, t, g, unknown or other
  modified_base (152)..(152): a, c, t, g, unknown or other
  modified_base (167)..(167): a, c, t, g, unknown or other
  modified_base (182)..(182): a, c, t, g, unknown or other
  modified_base (189)..(189): a, c, t, g, unknown or other
  modified_base (199)..(199): a, c, t, g, unknown or other
  modified_base (225)..(225): a, c, t, g, unknown or other
  modified_base (237)..(237): a, c, t, g, unknown or other
  modified_base (262)..(262): a, c, t, g, unknown or other
  modified_base (270)..(270): a, c, t, g, unknown or other
  modified_base (279)..(279): a, c, t, g, unknown or other
  modified_base (298)..(298): a, c, t, g, unknown or other
  modified_base (306)..(306): a, c, t, g, unknown or other
  modified_base (392)..(392): a, c, t, g, unknown or other
  modified_base (405)..(405): a, c, t, g, unknown or other
  modified_base (419)..(419): a, c, t, g, unknown or other
  modified_base (426)..(426): a, c, t, g, unknown or other
ttgtcagagntcagggtacaagcagctgtctgactccaaaccctttatngangctgcctggctttttctctagcncttnacttcttaattagtgcagagaancaagtcttgcctttcatttcttcccctgcacngaagaaaaatctaaaagncatccttttgtaacntgaaaacttggaatnaaaaatncattaaaatnttatctatagaaacactcccaaagcntcatagcaaganattcagataaaagcacatattttcnctactttnatgtgcatnagtttaaastccatgactnttattttnatcttcatcattccctatttgactgatttttaacctatcatsttacaccatggagtggcaaatactatcaaggaatcaaaaaaagncaactccttcaanaatctaatttatangaaatanagtaaattacaatgat

SEQ ID NO: 4638 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtsgtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4639 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccrcttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4640 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (176)..(176): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (326)..(326): a, c, t, g, unknown or other
  modified_base (329)..(329): a, c, t, g, unknown or other
  modified_base (360)..(360): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgngtaggtgtttggcacccaaaatttcactgaagaagaatgctgtttcttantatcaaaccaaagtgcaaagcaatataaattagaggccaagncttctcttgncgntcratttacttctgtaaaacagattctatgttccttttctatgancantttacatttgaaacattagattttttcactnatgagggaaggaaangggcttctgtnctacttnaagncngngaagctaaggtctccttctcaaagnagagcnggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 4641 - DNA, 175 bp, Artificial Sequence
  Description of Artificial Sequence: Synthetic polynucleotide
  modified_base (37)..(37): a, c, t, g, unknown or other
  modified_base (55)..(55): a, c, t, g, unknown or other
  modified_base (81)..(81): a, c, t, g, unknown or other
  modified_base (119)..(119): a, c, t, g, unknown or other
gataagcaccatttgrctgatctaagccatcttattngccatgaagcgccatacntgttccagaagtatgttaaagagtcncatggacgggatgtacgtgtcattgtcgtgggaggccntgtggttggcaccatgttacrttgttcaacagatgggagaatgcaaagcaactgct

SEQ ID NO: 4642 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagmacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4643 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgktttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4644 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttyctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4645 - DNA, 857 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  modified_base (442)..(442): a, c, t, g, unknown or other
  modified_base (500)..(500): a, c, t, g, unknown or other
  modified_base (511)..(511): a, c, t, g, unknown or other
  modified_base (514)..(514): a, c, t, g, unknown or other
  modified_base (533)..(533): a, c, t, g, unknown or other
  modified_base (540)..(540): a, c, t, g, unknown or other
  modified_base (547)..(547): a, c, t, g, unknown or other
  modified_base (570)..(570): a, c, t, g, unknown or other
  modified_base (609)..(609): a, c, t, g, unknown or other
  modified_base (660)..(660): a, c, t, g, unknown or other
  modified_base (755)..(755): a, c, t, g, unknown or other
  modified_base (760)..(760): a, c, t, g, unknown or other
  modified_base (767)..(767): a, c, t, g, unknown or other
  modified_base (787)..(787): a, c, t, g, unknown or other
  modified_base (808)..(808): a, c, t, g, unknown or other
  modified_base (813)..(813): a, c, t, g, unknown or other
  modified_base (819)..(819): a, c, t, g, unknown or other
  modified_base (821)..(821): a, c, t, g, unknown or other
  modified_base (825)..(825): a, c, t, g, unknown or other
  modified_base (850)..(850): a, c, t, g, unknown or other
tttcngctttattatttccttgatatccacagcagaanttcagaggtataacttcaacattaacaggtgaaaagttctacaatgactngttgcactcyatcacattaraataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattntttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatnccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 4646 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (103)..(103): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (170)..(170): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccanctgagakggtaatttttcccttgggnattagctgctnaggacctggccagcacttttganggcttcncagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctrtttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 4647 - DNA, 420 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (15)..(15): a, c, t, g, unknown or other
  modified_base (17)..(17): a, c, t, g, unknown or other
  modified_base (33)..(33): a, c, t, g, unknown or other
  modified_base (44)..(44): a, c, t, g, unknown or other
  modified_base (67)..(67): a, c, t, g, unknown or other
  modified_base (83)..(83): a, c, t, g, unknown or other
  modified_base (88)..(88): a, c, t, g, unknown or other
  modified_base (121)..(121): a, c, t, g, unknown or other
  modified_base (124)..(124): a, c, t, g, unknown or other
  modified_base (129)..(129): a, c, t, g, unknown or other
  modified_base (136)..(136): a, c, t, g, unknown or other
  modified_base (161)..(161): a, c, t, g, unknown or other
  modified_base (171)..(171): a, c, t, g, unknown or other
  modified_base (187)..(187): a, c, t, g, unknown or other
  modified_base (197)..(197): a, c, t, g, unknown or other
  modified_base (214)..(214): a, c, t, g, unknown or other
  modified_base (220)..(220): a, c, t, g, unknown or other
  modified_base (231)..(231): a, c, t, g, unknown or other
  modified_base (236)..(236): a, c, t, g, unknown or other
  modified_base (242)..(242): a, c, t, g, unknown or other
  modified_base (255)..(255): a, c, t, g, unknown or other
  modified_base (260)..(260): a, c, t, g, unknown or other
  modified_base (263)..(263): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (317)..(317): a, c, t, g, unknown or other
  modified_base (335)..(335): a, c, t, g, unknown or other
  modified_base (351)..(351): a, c, t, g, unknown or other
  modified_base (361)..(361): a, c, t, g, unknown or other
  modified_base (371)..(371): a, c, t, g, unknown or other
  modified_base (404)..(404): a, c, t, g, unknown or other
ccntcacatgccntntnctttatgtaaaaaccntccagcagaanagcaacagtcaccctcaggaggngatttagccccaagtncccanagaacagcctcaggccacgacttctgtgctscntcnctgtncccagmnccatctgccaagaccaggaattcanctttggagtntaacttgttttctctnttttttcacntctcaaaaaataaaaancttcantaatacarccnaaggnttaccntgtgtctaaaagnagganagnttcccataaacaatgttgtcagcttgagtgnggntaaacacagraaggnacacnataaattaaagcagaccntgactcttcagaggcnctgcggtgangtctgggggnccaratctgccagtggctgcatttccagcactncatagtgttgaggact

SEQ ID NO: 4648 - DNA, 606 bp, Artificial Sequence
  Description of Artificial Sequence: Synthetic polynucleotide
  modified_base (128)..(128): a, c, t, g, unknown or other
  modified_base (135)..(135): a, c, t, g, unknown or other
  modified_base (222)..(222): a, c, t, g, unknown or other
  modified_base (291)..(291): a, c, t, g, unknown or other
  modified_base (404)..(404): a, c, t, g, unknown or other
  modified_base (419)..(419): a, c, t, g, unknown or other
  modified_base (442)..(442): a, c, t, g, unknown or other
  modified_base (592)..(592): a, c, t, g, unknown or other
cctttacccacttttcctaaacaacccctaaaaaactttgctctgaaaagcagggaatatcactgtgcaaagtaagttgcttttctccacggggctatctgtgtaaaacttgccactgagagctctcnctgytcngctgtgacagcccagcctgcaggtgagcttgcttgcactcccacctgatcagagcacgcctcccygggtcagacactcaatatcctngccctgcaggaggccagagggcccatctgctgctcatggccaggctgggccttggggtgcctgaccccnccagagcaagccccttagatgcccrgcagaatcctctctcccctcctgtaccttggraggtttccccacactatgcccagtgtcaggctgaarttgggatcatggcacagganmctctggggccctcngagaatgaggtgcttgatgatgngcagaatctgaacgcagcctggacggaggtttgaggtcatcartggacagacagcttgtcccagcacttagaactcagggcagcagagctgcctagctgggcacaacctgggccaccccacagagggcaggagtgggagaggccaaaggnggtgatcccaggac

SEQ ID NO: 4649 - DNA, 150 bp, Artificial Sequence
  Description of Artificial Sequence: Synthetic polynucleotide
  modified_base (3)..(3): a, c, t, g, unknown or other
  modified_base (23)..(23): a, c, t, g, unknown or other
  modified_base (68)..(68): a, c, t, g, unknown or other
  modified_base (92)..(92): a, c, t, g, unknown or other
  modified_base (95)..(95): a, c, t, g, unknown or other
  modified_base (133)..(133): a, c, t, g, unknown or other
  modified_base (135)..(135): a, c, t, g, unknown or other
  modified_base (137)..(137): a, c, t, g, unknown or other
ggnaggccagggagcccacagcntttcraatggcttcattgttgggatcyacacctgggaggttctcnaggacactctgaaggaactcaggntcntgcatcacgycgtaatcatcctcctccttggctggctnrnangtgtccatggctg

SEQ ID NO: 4650 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnaraacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4651 - DNA, 411 bp, Artificial Sequence
  Description of Artificial Sequence: Synthetic polynucleotide
  modified_base (85)..(85): a, c, t, g, unknown or other
  modified_base (185)..(185): a, c, t, g, unknown or other
  modified_base (268)..(268): a, c, t, g, unknown or other
  modified_base (360)..(360): a, c, t, g, unknown or other
  modified_base (367)..(367): a, c, t, g, unknown or other
ggataggtaggatttacagactggaaaatgggaaaaagatgagagtggaaaaaggaaggaggggtagcamgaatggcgggcaggnrgacagaaargtaaaattcagccatgttcaaaagggaacaaataaaagcacygaaaggtaagacagacctagtatatttatgacttgaatcccaagctangaaactggaacataatttagcagagagactccaaaagttttacagcaaaaagtattagaatcatttatatactgggaaaaaantagcctcctcattttaataatccagattgggaaatcagatctaaaacagatgttcaatggacatcccatttcttttgtaaaagcaacttganggtcagncatcaagttttgttctgtttttaattcacaatgaaaatctgact

SEQ ID NO: 4652 - DNA, 408 bp, Artificial Sequence
  Description of Artificial Sequence: Synthetic polynucleotide
  modified_base (14)..(43): a, c, t, g, unknown or other
  modified_base (65)..(65): a, c, t, g, unknown or other
  modified_base (304)..(304): a, c, t, g, unknown or other
  modified_base (355)..(355): a, c, t, g, unknown or other
  modified_base (357)..(357): a, c, t, g, unknown or other
  modified_base (359)..(359): a, c, t, g, unknown or other
ttgagttgttatcnnnnnnnnnnnnnnnnnnnnnnnnnnnnnnawttccaagaggtgcccacrtnggctaagtaccaaacagggtactagggaattttayttctgagttaaatgccattctagttgttttttcttcatctccagtaaggttatctttattyaccagttgttacaatagytgtgggtcttgcttctcacagttttatgctrtctgtgctattttctctrctgatcrtcaccacaatcattattgcttatcataattgttatctttattttctcctttaatcaagaatcrgtcttntatctcattattctctttygcaggcttcaggataattatggttggagtgcnantnsgggraaccagtgcagctaagctctgacrtctttgcatcccttttccat

SEQ ID NO: 4653 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtrcagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4654 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  modified_base (89)..(89): a, c, t, g, unknown or other
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (243)..(243): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctacttncaagttctttccccaaacttttctcacctatgtttncctatggggctntngaytcagnttcatgngcaatgtgttcctataaagaagaaggagtgtagggycaccttcngcttatgttttagctctagaggatgagrgaagagccaacgtgtgncagtttgaggatggatgtacagtgagtagtgaggggctttttccaccttgaanrcatgagngctcttgagnccctcccactgnanttcagagtcaccagatntgtgcatgatatctctgc

SEQ ID NO: 4655 - DNA, 611 bp, Artificial Sequence
  Description of Artificial Sequence: Synthetic polynucleotide
  modified_base (1)..(1): a, c, t, g, unknown or other
  modified_base (3)..(3): a, c, t, g, unknown or other
  modified_base (43)..(43): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (134)..(134): a, c, t, g, unknown or other
  modified_base (140)..(140): a, c, t, g, unknown or other
  modified_base (156)..(156): a, c, t, g, unknown or other
  modified_base (179)..(179): a, c, t, g, unknown or other
  modified_base (189)..(189): a, c, t, g, unknown or other
  modified_base (200)..(200): a, c, t, g, unknown or other
  modified_base (238)..(238): a, c, t, g, unknown or other
  modified_base (249)..(249): a, c, t, g, unknown or other
  modified_base (257)..(257): a, c, t, g, unknown or other
  modified_base (262)..(262): a, c, t, g, unknown or other
  modified_base (267)..(267): a, c, t, g, unknown or other
  modified_base (278)..(278): a, c, t, g, unknown or other
  modified_base (308)..(308): a, c, t, g, unknown or other
  modified_base (349)..(349): a, c, t, g, unknown or other
  modified_base (365)..(365): a, c, t, g, unknown or other
  modified_base (382)..(382): a, c, t, g, unknown or other
  modified_base (412)..(412): a, c, t, g, unknown or other
  modified_base (421)..(421): a, c, t, g, unknown or other
  modified_base (423)..(423): a, c, t, g, unknown or other
  modified_base (450)..(450): a, c, t, g, unknown or other
  modified_base (473)..(473): a, c, t, g, unknown or other
  modified_base (531)..(531): a, c, t, g, unknown or other
  modified_base (535)..(535): a, c, t, g, unknown or other
  modified_base (571)..(571): a, c, t, g, unknown or other
  modified_base (573)..(573): a, c, t, g, unknown or other
  modified_base (575)..(575): a, c, t, g, unknown or other
  modified_base (580)..(580): a, c, t, g, unknown or other
  modified_base (600)..(600): a, c, t, g, unknown or other
  modified_base (608)..(608): a, c, t, g, unknown or other
nanatttacttttaatctcatgagatgctgaggactaagaccncctccttcccagggcccaaagcaagaaaatgnggntgngangaggcccatctccanagatcttacccttggaataagggtctttttcccanacctcnttgacatctattcccnctgggctgtttttattttcctancccacactcntcagctttaangcactaaagaactttttggccacctcagracaaaaatntgttacaaaancacctccnaaatnraatnagctsagcctnactaagtaaatcaggctttggacaggctcngcttcctgttggttgttcatacatttgtgttgctcaagtcnatcttagaacccaacnccgccttgctggattcntgatggaatttctctttgcacctgaacaantcttcaggnancttctccttttaattttgaagaatgtnatacctttctgtcagaaaaggtntccaggtcttagattcacactcaagccatgaataatactcttctgggcatacataaanacangatttycccaaattctccttctcctagcacagagancncncttcnttccttccctttccctagcnttctttcnaat

SEQ ID NO: 4656 - DNA, 793 bp, Artificial Sequence
  Description of Artificial Sequence: Synthetic polynucleotide
  modified_base (9)..(9): a, c, t, g, unknown or other
  modified_base (61)..(61): a, c, t, g, unknown or other
  modified_base (79)..(79): a, c, t, g, unknown or other
  modified_base (110)..(110): a, c, t, g, unknown or other
  modified_base (112)..(112): a, c, t, g, unknown or other
  modified_base (125)..(125): a, c, t, g, unknown or other
  modified_base (155)..(155): a, c, t, g, unknown or other
  modified_base (162)..(162): a, c, t, g, unknown or other
  modified_base (197)..(197): a, c, t, g, unknown or other
  modified_base (208)..(208): a, c, t, g, unknown or other
  modified_base (218)..(218): a, c, t, g, unknown or other
  modified_base (229)..(229): a, c, t, g, unknown or other
  modified_base (240)..(240): a, c, t, g, unknown or other
  modified_base (251)..(251): a, c, t, g, unknown or other
  modified_base (256)..(256): a, c, t, g, unknown or other
  modified_base (277)..(277): a, c, t, g, unknown or other
  modified_base (281)..(281): a, c, t, g, unknown or other
  modified_base (302)..(302): a, c, t, g, unknown or other
  modified_base (315)..(315): a, c, t, g, unknown or other
  modified_base (328)..(328): a, c, t, g, unknown or other
  modified_base (343)..(343): a, c, t, g, unknown or other
  modified_base (349)..(349): a, c, t, g, unknown or other
  modified_base (361)..(361): a, c, t, g, unknown or other
  modified_base (389)..(389): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  modified_base (474)..(474): a, c, t, g, unknown or other
  modified_base (487)..(487): a, c, t, g, unknown or other
  modified_base (496)..(496): a, c, t, g, unknown or other
  modified_base (518)..(518): a, c, t, g, unknown or other
  modified_base (533)..(533): a, c, t, g, unknown or other
  modified_base (542)..(542): a, c, t, g, unknown or other
  modified_base (552)..(552): a, c, t, g, unknown or other
  modified_base (601)..(601): a, c, t, g, unknown or other
  modified_base (608)..(608): a, c, t, g, unknown or other
  modified_base (619)..(619): a, c, t, g, unknown or other
  modified_base (625)..(625): a, c, t, g, unknown or other
  modified_base (633)..(633): a, c, t, g, unknown or other
  modified_base (638)..(638): a, c, t, g, unknown or other
  modified_base (641)..(641): a, c, t, g, unknown or other
  modified_base (643)..(643): a, c, t, g, unknown or other
  modified_base (655)..(655): a, c, t, g, unknown or other
  modified_base (682)..(682): a, c, t, g, unknown or other
  modified_base (698)..(698): a, c, t, g, unknown or other
  modified_base (723)..(723): a, c, t, g, unknown or other
  modified_base (759)..(759): a, c, t, g, unknown or other
  modified_base (785)..(785): a, c, t, g, unknown or other
aaagttctncttactagaaaaaaggattgtgaattcttcccacttctcacttatcatctgntaagcattttgcagatangacatctagatatgggaaaacataagaaaantntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactngaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcnttactttgtactctacagtgcttgtttarctcttanggggtttgttctattaaattacactncataataa

SEQ ID NO: 4657 - DNA, 149 bp, Artificial Sequence
  Description of Artificial Sequence: Synthetic polynucleotide
  modified_base (15)..(15): a, c, t, g, unknown or other
  modified_base (19)..(19): a, c, t, g, unknown or other
  modified_base (26)..(26): a, c, t, g, unknown or other
  modified_base (33)..(33): a, c, t, g, unknown or other
  modified_base (51)..(51): a, c, t, g, unknown or other
  modified_base (63)..(63): a, c, t, g, unknown or other
  modified_base (69)..(69): a, c, t, g, unknown or other
  modified_base (74)..(74): a, c, t, g, unknown or other
  modified_base (77)..(77): a, c, t, g, unknown or other
  modified_base (81)..(81): a, c, t, g, unknown or other
  modified_base (103)..(103): a, c, t, g, unknown or other
  modified_base (109)..(109): a, c, t, g, unknown or other
ttgttaaattcaagncagnggtccancatttcntgcttagccaaagaaganctcttttcctcntggttntgtanatntgtncctgagttttaagtgccacatntttcangtcagttwcacatcctgcctttaggctctcagacttgtac

SEQ ID NO: 4658 - DNA, 828 bp, Artificial Sequence
  Description of Artificial Sequence: Synthetic polynucleotide
  modified_base (4)..(4): a, c, t, g, unknown or other
  modified_base (13)..(13): a, c, t, g, unknown or other
  modified_base (18)..(18): a, c, t, g, unknown or other
  modified_base (21)..(21): a, c, t, g, unknown or other
  modified_base (53)..(53): a, c, t, g, unknown or other
  modified_base (67)..(67): a, c, t, g, unknown or other
  modified_base (69)..(69): a, c, t, g, unknown or other
  modified_base (86)..(86): a, c, t, g, unknown or other
  modified_base (95)..(95): a, c, t, g, unknown or other
  modified_base (117)..(117): a, c, t, g, unknown or other
  modified_base (120)..(120): a, c, t, g, unknown or other
  modified_base (130)..(130): a, c, t, g, unknown or other
  modified_base (144)..(144): a, c, t, g, unknown or other
  modified_base (184)..(184): a, c, t, g, unknown or other
  modified_base (207)..(207): a, c, t, g, unknown or other
  modified_base (211)..(211): a, c, t, g, unknown or other
  modified_base (223)..(223): a, c, t, g, unknown or other
  modified_base (228)..(228): a, c, t, g, unknown or other
  modified_base (257)..(257): a, c, t, g, unknown or other
  modified_base (279)..(279): a, c, t, g, unknown or other
  modified_base (284)..(284): a, c, t, g, unknown or other
  modified_base (292)..(292): a, c, t, g, unknown or other
  modified_base (313)..(313): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (338)..(338): a, c, t, g, unknown or other
  modified_base (372)..(493): a, c, t, g, unknown or other
  modified_base (499)..(499): a, c, t, g, unknown or other
  modified_base (521)..(521): a, c, t, g, unknown or other
  modified_base (549)..(549): a, c, t, g, unknown or other
  modified_base (557)..(557): a, c, t, g, unknown or other
  modified_base (565)..(565): a, c, t, g, unknown or other
  modified_base (569)..(591): a, c, t, g, unknown or other
  modified_base (593)..(593): a, c, t, g, unknown or other
  modified_base (610)..(610): a, c, t, g, unknown or other
  modified_base (650)..(650): a, c, t, g, unknown or other
  modified_base (686)..(686): a, c, t, g, unknown or other
  modified_base (720)..(720): a, c, t, g, unknown or other
  modified_base (746)..(746): a, c, t, g, unknown or other
  modified_base (764)..(764): a, c, t, g, unknown or other
  modified_base (786)..(786): a, c, t, g, unknown or other
  modified_base (788)..(788): a, c, t, g, unknown or other
  modified_base (803)..(803): a, c, t, g, unknown or other
  modified_base (805)..(805): a, c, t, g, unknown or other
  modified_base (821)..(821): a, c, t, g, unknown or other
tatncatgtgtantgcanacnttctttcttcctttctcatccttgcagtcgcnttctcttccttttncntctttcattccrtttangtgtcaaanaccacargtctgggaaaggaanaanatgtaagagnaagatgcctactangtgggcacatagagagctcctggtgggacagggactgcanagaagagccactgcttggagagntttntcaaaaactctnccttnatstaaatgaatttcaacagcaaagtgangacatatccacacatttaaatnaaatncttccccntttccctggcakttaatatangaaatantntancatgtttatcaanggaaaacaccaccaaagacctgctttttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatngtcataattggtcctgtctaanatgagagccatggggaatgcccaattanattggytngtttcctnccannnnnnnnnnnnnnnnnnnnnnntntcctgatgaggtggttntccagatacttgtatctggtatccagattttctctgcttntccacagcaagaaatgatgtagggcatctctaggcngtcttttgcccctaatccagactcatgggtctcngggattaagggtcctccaccaattcntaagaccttcacctattntccttgttaccatcatcacaananttctgtttctgattncncctgctcctctcccanattttta

SEQ ID NO: 4659 - DNA, 161 bp, Artificial Sequence
  Description of Artificial Sequence: Synthetic polynucleotide
  modified_base (127)..(127): a, c, t, g, unknown or other
atagtattctcacccttttctactcacattccctctgagctaattagtgctattggctgrtgtgtatccttccactcacatttacttactcgtacattcaaatgcaaaatacacatacatacatagnatggtggtggttgtattttaaaatgaaattattt

SEQ ID NO: 4660 - DNA, 182 bp, Artificial Sequence
  Description of Artificial Sequence: Synthetic polynucleotide
  modified_base (131)..(131): a, c, t, g, unknown or other
  modified_base (140)..(140): a, c, t, g, unknown or other
  modified_base (159)..(159): a, c, t, g, unknown or other
attgtcctggacccaaagccatccccacccattcattgtcctgctgggagctgtctggctctgggcgatatgaggagggactcactggagctgggaggggtttgartgcagctgtggggaagcagaggctnagctgggcngcacagcatggaggtcccncccgaccctccctgcagggtgct

SEQ ID NO: 4661 - DNA, 511 bp, Artificial Sequence
  Description of Artificial Sequence: Synthetic polynucleotide
  modified_base (153)..(153): a, c, t, g, unknown or other
  modified_base (236)..(236): a, c, t, g, unknown or other
aaacatcagagcayttaattctgacttggtgtaaggtgtatatcttatgtttgaacccactcttcctgtgggttttgttttaaaagaaatgactactattttrtcttctcctgtagctatttctggaccctttgtggtttaagaaggaatacngggaggagaaagagaaaaaaaatgaaatcatccaggcaaggaagtttagaaagcagaggtttaggagaagaaaaagaagagangtttctggyagcttcctgattttagaagctgattttgctacttttctttaattctgaggtagtttcaartattttgttgttacctttctggaaagaaataagtttatcrtttctacttttggatgtttttaggtgccagctaaaatacaaccctcatttattttccttgatgcagaaacctaacttctctaatttagcatacgagaagaccagtttgggaatatttaaagttcttcactttgggaaccttagatgttggtcgtccttagtaaaat

SEQ ID NO: 4662 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctrtncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4663 - DNA, 260 bp, Artificial Sequence
  Description of Artificial Sequence: Synthetic polynucleotide
  modified_base (15)..(15): a, c, t, g, unknown or other
  modified_base (44)..(44): a, c, t, g, unknown or other
  modified_base (74)..(74): a, c, t, g, unknown or other
  modified_base (96)..(96): a, c, t, g, unknown or other
  modified_base (122)..(122): a, c, t, g, unknown or other
  modified_base (188)..(188): a, c, t, g, unknown or other
  modified_base (200)..(200): a, c, t, g, unknown or other
  modified_base (204)..(204): a, c, t, g, unknown or other
  modified_base (207)..(207): a, c, t, g, unknown or other
  modified_base (209)..(209): a, c, t, g, unknown or other
  modified_base (212)..(212): a, c, t, g, unknown or other
  modified_base (214)..(214): a, c, t, g, unknown or other
  modified_base (225)..(225): a, c, t, g, unknown or other
  modified_base (228)..(228): a, c, t, g, unknown or other
  modified_base (246)..(246): a, c, t, g, unknown or other
ctcataattttagtntatcttttagctttatgttgcyataaacntttcattatatacatgatcaacaacagcanattatctcacctcagtatttanttattttacaaactgatttatgattnctaacatgtaactgaaggtatacactrttagaacacagttttcagtagaaagtagcactgccattnagtaataaaatnttynaanantanancaacattcttntanaagtttgcatgttgtttnctgaggtctaaagc

SEQ ID NO: 4664 - DNA, 764 bp, Artificial Sequence
  Description of Artificial Sequence: Synthetic polynucleotide
  modified_base (134)..(134): a, c, t, g, unknown or other
  modified_base (183)..(183): a, c, t, g, unknown or other
  modified_base (198)..(198): a, c, t, g, unknown or other
  modified_base (267)..(267): a, c, t, g, unknown or other
  modified_base (342)..(342): a, c, t, g, unknown or other
  modified_base (391)..(391): a, c, t, g, unknown or other
  modified_base (415)..(415): a, c, t, g, unknown or other
  modified_base (561)..(561): a, c, t, g, unknown or other
  misc_feature (596)..(596): May or may not be present
tatttttaaatgctgaaaaatgaaatactaaattatttatgaatakataacttcaataaaagatgagaaaatacaactaggtcattaggacaatttgtatgaaacaatatccaatttgctgtctgttacttctnaccttatcatgtctaatttttcctcatctttgtgaaatcctgcrtctanaataggcaaraaaancaaaaaacaaaaggaatcttattctattcacagccatcagaaaaatgtgttactattcctgtagtcagngttctaaatcatacatttgagatatatytsaaacatgtcataaagaaaataagcatcatatttctmactaaatancacctgaaatattccatatgaaaggaaaaatacraaaaactaaactttnaattactaacctccttaaaggaanataattctatatgatttgatatttsataatggatgtccaatacctgagatataaattccattttctgtgtcctaacatctcaccttcagaaaatctccaatattgggttatttggattatatatttaaaactgaatatacttgaanatgtgaawgatttgttgchrcaacaaatggtttagcaattatctgcattaaaatgtgttccatgaacaacagaaaaagaatatttctacttcagtccttaaaaattgtgaaagcacasccacagtcttagtttgtcgatctysaattcttttggtattttaatttcaccaataattcyggaactgctgtttttrtatttctca

SEQ ID NO: 4665 - DNA, 665 bp, Artificial Sequence
  Description of Artificial Sequence: Synthetic polynucleotide
  modified_base (39)..(39): a, c, t, g, unknown or other
  modified_base (45)..(45): a, c, t, g, unknown or other
  modified_base (48)..(48): a, c, t, g, unknown or other
  modified_base (62)..(62): a, c, t, g, unknown or other
  modified_base (70)..(70): a, c, t, g, unknown or other
  modified_base (84)..(84): a, c, t, g, unknown or other
  modified_base (89)..(89): a, c, t, g, unknown or other
  modified_base (108)..(108): a, c, t, g, unknown or other
  modified_base (113)..(113): a, c, t, g, unknown or other
  modified_base (130)..(130): a, c, t, g, unknown or other
  modified_base (140)..(140): a, c, t, g, unknown or other
  modified_base (162)..(162): a, c, t, g, unknown or other
  modified_base (165)..(165): a, c, t, g, unknown or other
  modified_base (169)..(169): a, c, t, g, unknown or other
  modified_base (193)..(193): a, c, t, g, unknown or other
  modified_base (197)..(197): a, c, t, g, unknown or other
  modified_base (224)..(224): a, c, t, g, unknown or other
  modified_base (226)..(226): a, c, t, g, unknown or other
  modified_base (230)..(230): a, c, t, g, unknown or other
  modified_base (235)..(235): a, c, t, g, unknown or other
  modified_base (245)..(245): a, c, t, g, unknown or other
  modified_base (250)..(250): a, c, t, g, unknown or other
  modified_base (252)..(252): a, c, t, g, unknown or other
  modified_base (266)..(266): a, c, t, g, unknown or other
  modified_base (278)..(278): a, c, t, g, unknown or other
  modified_base (291)..(291): a, c, t, g, unknown or other
  modified_base (305)..(305): a, c, t, g, unknown or other
  modified_base (322)..(322): a, c, t, g, unknown or other
  modified_base (352)..(352): a, c, t, g, unknown or other
  modified_base (363)..(363): a, c, t, g, unknown or other
  modified_base (367)..(367): a, c, t, g, unknown or other
  modified_base (395)..(395): a, c, t, g, unknown or other
  modified_base (429)..(429): a, c, t, g, unknown or other
  modified_base (444)..(444): a, c, t, g, unknown or other
  modified_base (460)..(460): a, c, t, g, unknown or other
  modified_base (477)..(477): a, c, t, g, unknown or other
  modified_base (486)..(486): a, c, t, g, unknown or other
  modified_base (488)..(488): a, c, t, g, unknown or other
  modified_base (493)..(493): a, c, t, g, unknown or other
  modified_base (510)..(510): a, c, t, g, unknown or other
  modified_base (515)..(515): a, c, t, g, unknown or other
  modified_base (517)..(517): a, c, t, g, unknown or other
  modified_base (519)..(519): a, c, t, g, unknown or other
  modified_base (539)..(539): a, c, t, g, unknown or other
  modified_base (559)..(559): a, c, t, g, unknown or other
  modified_base (561)..(561): a, c, t, g, unknown or other
  modified_base (607)..(607): a, c, t, g, unknown or other
  modified_base (609)..(609): a, c, t, g, unknown or other
  modified_base (615)..(615): a, c, t, g, unknown or other
  modified_base (621)..(621): a, c, t, g, unknown or other
  modified_base (640)..(640): a, c, t, g, unknown or other
  modified_base (642)..(642): a, c, t, g, unknown or other
  modified_base (644)..(644): a, c, t, g, unknown or other
caggcagcacctcacrgaatccaggctcacagaaagtcngtttcnatnagaatttaaaacanccctcttntgctgcaactcttnaggcnactgacaaggtgacaggancacantttgtacaggatacaancatattcccnatgggtggacaaaacgaccccntancccntctacaccaaggagctgcacctgngccntgtgtagccagatgcaattttctattntngganaatcnactttaagtngttcntnagcaaattcttccnaagtactgtttnctttcctcaattnctggcctagcaagntagaaagaaaacaaaangaatgtaaaatgttcttggttgactttacncttaattactnaaangcaaacagagaaaattaaaatcaaacantgcaaaaaattcttctagagccttgcacacaatnccagttcttgaaatnttcataaagcaaagcnaatgaaataaacaaagncrtggctgnanggatntgcattgtactrtgctnatggncnanttgctcactgcatctctcgntccacygccrccrggctcrncnccagaagcctgttcctgagctgattggggttctggkccaggggtcncnaggagngaggcncaagctcaggaggacaaanancnaccacctggaaagtggcaaaa

SEQ ID NO: 4666 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggakcnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4667 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttaycttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4668 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  misc_feature (1576)..(1576): May or may not be present
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagattttttcactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4669 - DNA, 642 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (138)..(138): a, c, t, g, unknown or other
  modified_base (219)..(219): a, c, t, g, unknown or other
  modified_base (300)..(300): a, c, t, g, unknown or other
  modified_base (314)..(314): a, c, t, g, unknown or other
  modified_base (323)..(323): a, c, t, g, unknown or other
  modified_base (463)..(463): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcatttncttgcaaatagcctaccctttctcttacacgtcctttgacacattttagatggtttngccatacaaaacntttcnattttnagttaaangtaggctnagnaaacatttcaagaaactgaagtgtttcttttttcacctgcttttaatctaaagtcttattatatctggattttaacatttnttaaaagtaatgtcagattataaatgtttggattttattcattttctaaatgattctgactggtttcctacatatayaatnatgaccygcaaaanaagatgtgncctttactttctaattatttgcaactaatctgtactggtttatacatctaggaaactgatgagcaactggtgggagtgtgtatctttttcatatgaagcatgcttctagtggtttactattagacaataatgggttggcntttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4670 - DNA, 131 bp, Artificial Sequence
  Description of Artificial Sequence: Synthetic polynucleotide
atamgcgtgctaattataaagttcttcaattttctcttaaggaacattctctgttttgttttaaagaaaaagttacagtaatttrtaagtgtttttcatttgttattctcttcctactactgcagcataat

SEQ ID NO: 4671 - DNA, 200 bp, Artificial Sequence
  Description of Artificial Sequence: Synthetic polynucleotide
  modified_base (13)..(13): a, c, t, g, unknown or other
  modified_base (40)..(40): a, c, t, g, unknown or other
  modified_base (67)..(67): a, c, t, g, unknown or other
  modified_base (94)..(94): a, c, t, g, unknown or other
  modified_base (96)..(96): a, c, t, g, unknown or other
  modified_base (111)..(111): a, c, t, g, unknown or other
  modified_base (143)..(143): a, c, t, g, unknown or other
rttcctcaggcancagagaycaatggaractttcagcacngaagtggcctatcaggtctgtcttttngaagaacactgtaatagaacagtgcangntgctcacttccttcnttgtaaacccaaaccatggttcttyaagttcnagtgcaataacyttggaataacaaggtatcagtcatctcaattaccacccatagtac

SEQ ID NO: 4672 - DNA, 358 bp, Artificial Sequence
  Description of Artificial Sequence: Synthetic polynucleotide
  modified_base (48)..(48): a, c, t, g, unknown or other
  modified_base (55)..(55): a, c, t, g, unknown or other
  modified_base (103)..(103): a, c, t, g, unknown or other
  modified_base (117)..(117): a, c, t, g, unknown or other
  modified_base (123)..(123): a, c, t, g, unknown or other
  modified_base (147)..(147): a, c, t, g, unknown or other
  modified_base (178)..(178): a, c, t, g, unknown or other
  modified_base (215)..(215): a, c, t, g, unknown or other
  modified_base (224)..(224): a, c, t, g, unknown or other
  modified_base (227)..(227): a, c, t, g, unknown or other
  modified_base (254)..(254): a, c, t, g, unknown or other
  modified_base (266)..(266): a, c, t, g, unknown or other
  modified_base (279)..(279): a, c, t, g, unknown or other
  modified_base (295)..(295): a, c, t, g, unknown or other
  modified_base (298)..(298): a, c, t, g, unknown or other
  modified_base (304)..(304): a, c, t, g, unknown or other
  modified_base (318)..(318): a, c, t, g, unknown or other
  modified_base (324)..(324): a, c, t, g, unknown or other
  modified_base (341)..(341): a, c, t, g, unknown or other
ctgctgccgtagagcctggagcagcacgaccggcttggccttctccanccccagncagcamtgcagaggacaccgcagggactccccaagtgtccgcaccccngggcctgccagggncctccncctgctgggctgccctccctgtgngcaaggtgtgaggagattcttrgagagagtntcccctgggttgcagagtcctratggaatctcacagnaaaattgcntgncccccaatgtcctaggtgtagcgttcntttcagtttttncattagaaatgtntccctgaaggctcatntcngtgccntgagaaaagagaangccatngtcacaataaccctccnttctgaccaggatggag

SEQ ID NO: 4673 - DNA, 167 bp, Artificial Sequence
  Description of Artificial Sequence: Synthetic polynucleotide
  modified_base (12)..(12): a, c, t, g, unknown or other
  modified_base (79)..(79): a, c, t, g, unknown or other
  modified_base (123)..(123): a, c, t, g, unknown or other
  modified_base (135)..(135): a, c, t, g, unknown or other
  modified_base (143)..(143): a, c, t, g, unknown or other
  modified_base (146)..(146): a, c, t, g, unknown or other
  modified_base (157)..(157): a, c, t, g, unknown or other
gagaagatcaangtctgtggtaagaagacgaagcttcagtatctcmccartcagattaaggcgatcaagaacacccttnagaagaaggtttagcagatctcccatccgtcgtaaaagatccangtcttctgaacnaggcagancanccaaacgtctnacagatttgg

SEQ ID NO: 4674 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgytgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4675 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttwaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4676 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttgggayaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4677 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgsaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4678 - DNA, 920 bp, Artificial Sequence
  Description of Artificial Sequence: Synthetic polynucleotide
  modified_base (184)..(184): a, c, t, g, unknown or other
  misc_feature (195)..(196): This region may encompass 'tt' or 'gc'
  modified_base (257)..(257): a, c, t, g, unknown or other
  modified_base (277)..(277): a, c, t, g, unknown or other
  modified_base (317)..(317): a, c, t, g, unknown or other
  modified_base (624)..(624): a, c, t, g, unknown or other
  modified_base (680)..(680): a, c, t, g, unknown or other
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaantgacccctggkyagagccaggcgcagcacagacagaaagccctgcctgaaagtgactggagccaagagcctgncactctcggctcattccgtncagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggnctccttggaaccrgctggacatggcggtgacgggacctagtctgcgagtcgagtcntgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4679 - DNA, 144 bp, Artificial Sequence
  Description of Artificial Sequence: Synthetic polynucleotide
  modified_base (25)..(25): a, c, t, g, unknown or other
  misc_feature (32)..(33): This region may encompass 'ag' or 'ca'
  modified_base (63)..(63): a, c, t, g, unknown or other
  modified_base (65)..(65): a, c, t, g, unknown or other
  modified_base (71)..(71): a, c, t, g, unknown or other
  modified_base (75)..(75): a, c, t, g, unknown or other
  modified_base (97)..(97): a, c, t, g, unknown or other
  modified_base (102)..(102): a, c, t, g, unknown or other
  modified_base (111)..(111): a, c, t, g, unknown or other
  modified_base (136)..(136): a, c, t, g, unknown or other
gatgccaacgtcctttccatgcacntcagggmracagtgccatttacacatttgggctgtgtntngggagnactngggagctttgagaayctgctgnggccncagcagcantgacaccagagatgactggggtggnattcatgg

SEQ ID NO: 4680 - DNA, 642 bp, Artificial Sequence
  Description of Artificial Sequence: Synthetic polynucleotide
  modified_base (7)..(7): a, c, t, g, unknown or other
  modified_base (38)..(38): a, c, t, g, unknown or other
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (219)..(219): a, c, t, g, unknown or other
  modified_base (296)..(296): a, c, t, g, unknown or other
  modified_base (300)..(300): a, c, t, g, unknown or other
  modified_base (314)..(314): a, c, t, g, unknown or other
  modified_base (323)..(323): a, c, t, g, unknown or other
  modified_base (463)..(463): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcatttncttgcaaatagcctaccctttctcttacacgtcctttgacacattttagatggtttngccatacaaaacntttcnattttnagttaaangtaggctnagraaacatttcaagaaactgaagtgtttcttttttcacctgcttttaatctaaagtcttattatatctggattttaacatttnttaaaagtaatgtcagattataaatgtttggattttattcattttctaaatgattctgactggtttcctacatatanaatnatgaccygcaaaanaagatgtgncctttactttctaattatttgcaactaatctgtactggtttatacatctaggaaactgatgagcaactggtgggagtgtgtatctttttcatatgaagcatgcttctagtggtttactattagacaataatgggttggcntttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4681 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctytttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4682 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagataygcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4683 - DNA, 100 bp, Artificial Sequence
  Description of Artificial Sequence: Synthetic polynucleotide
caacggccagggtggacactgttactkgggccatgatctttgtgcaagacaagtaataagaaaatcagtggtagaaatgtggtgttccaaatccacattc

SEQ ID NO: 4684 - DNA, 442 bp, Artificial Sequence
  Description of Artificial Sequence: Synthetic polynucleotide
  modified_base (22)..(22): a, c, t, g, unknown or other
  modified_base (27)..(27): a, c, t, g, unknown or other
  modified_base (60)..(60): a, c, t, g, unknown or other
  modified_base (68)..(68): a, c, t, g, unknown or other
  modified_base (74)..(74): a, c, t, g, unknown or other
  modified_base (113)..(113): a, c, t, g, unknown or other
  modified_base (123)..(123): a, c, t, g, unknown or other
  modified_base (150)..(150): a, c, t, g, unknown or other
  modified_base (188)..(188): a, c, t, g, unknown or other
  modified_base (209)..(209): a, c, t, g, unknown or other
  modified_base (219)..(219): a, c, t, g, unknown or other
  modified_base (227)..(227): a, c, t, g, unknown or other
  modified_base (254)..(254): a, c, t, g, unknown or other
  modified_base (266)..(266): a, c, t, g, unknown or other
  modified_base (280)..(280): a, c, t, g, unknown or other
  modified_base (311)..(311): a, c, t, g, unknown or other
  modified_base (322)..(322): a, c, t, g, unknown or other
  modified_base (329)..(329): a, c, t, g, unknown or other
  modified_base (345)..(345): a, c, t, g, unknown or other
  modified_base (353)..(353): a, c, t, g, unknown or other
  modified_base (360)..(360): a, c, t, g, unknown or other
  modified_base (362)..(362): a, c, t, g, unknown or other
  modified_base (397)..(397): a, c, t, g, unknown or other
  modified_base (403)..(403): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (429)..(429): a, c, t, g, unknown or other
tatttgattgacaatgaaaatngtctncagtatgcaattatgacacatagattagttttnagaaagtntttggntrgtatatttaatgttggacagtgcttctttaacaagtntattaaaccnctccaacaaaacttggtaaragaaagntctycttcagtttccttcctggaacttaagctcatcrnggtaggatacccagaatagangraaaattgncacttttncattgcttgactggtctgtcttacrtntatcctgatgcnggcttcaggcaganaatctctctgttactagctttgaaattttcncaagatattgnagtaatntagtgatgaagtaggncattctanagaatancngtaaggggttttcttcttcctcatagcacccatangacctnctctnctcccncacatacanaatttntacctcagttttc

SEQ ID NO: 4685 - DNA, 1141 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  modified_base (194)..(194): a, c, t, g, unknown or other
  modified_base (211)..(211): a, c, t, g, unknown or other
  modified_base (231)..(231): a, c, t, g, unknown or other
  modified_base (254)..(254): a, c, t, g, unknown or other
  modified_base (287)..(287): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (331)..(331): a, c, t, g, unknown or other
  modified_base (356)..(356): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
  modified_base (394)..(394): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (443)..(443): a, c, t, g, unknown or other
  modified_base (458)..(458): a, c, t, g, unknown or other
  modified_base (476)..(476): a, c, t, g, unknown or other
  modified_base (488)..(488): a, c, t, g, unknown or other
  modified_base (498)..(498): a, c, t, g, unknown or other
  modified_base (512)..(512): a, c, t, g, unknown or other
  modified_base (525)..(525): a, c, t, g, unknown or other
  modified_base (534)..(534): a, c, t, g, unknown or other
  modified_base (536)..(536): a, c, t, g, unknown or other
  modified_base (636)..(636): a, c, t, g, unknown or other
  modified_base (640)..(640): a, c, t, g, unknown or other
  modified_base (654)..(654): a, c, t, g, unknown or other
  modified_base (656)..(656): a, c, t, g, unknown or other
  modified_base (667)..(667): a, c, t, g, unknown or other
  modified_base (669)..(669): a, c, t, g, unknown or other
  modified_base (676)..(676): a, c, t, g, unknown or other
  modified_base (719)..(756): a, c, t, g, unknown or other
  modified_base (758)..(822): a, c, t, g, unknown or other
  modified_base (844)..(844): a, c, t, g, unknown or other
  modified_base (865)..(865): a, c, t, g, unknown or other
  modified_base (873)..(873): a, c, t, g, unknown or other
  modified_base (883)..(883): a, c, t, g, unknown or other
  modified_base (887)..(887): a, c, t, g, unknown or other
  modified_base (892)..(892): a, c, t, g, unknown or other
  modified_base (894)..(894): a, c, t, g, unknown or other
  modified_base (923)..(923): a, c, t, g, unknown or other
  modified_base (932)..(932): a, c, t, g, unknown or other
  modified_base (938)..(938): a, c, t, g, unknown or other
  modified_base (940)..(940): a, c, t, g, unknown or other
  modified_base (954)..(954): a, c, t, g, unknown or other
  modified_base (973)..(973): a, c, t, g, unknown or other
  modified_base (978)..(978): a, c, t, g, unknown or other
  modified_base (986)..(986): a, c, t, g, unknown or other
  modified_base (1000)..(1000): a, c, t, g, unknown or other
  modified_base (1010)..(1094): a, c, t, g, unknown or other
  modified_base (1096)..(1114): a, c, t, g, unknown or other
  modified_base (1135)..(1135): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttantattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcrtccactaaccagaagcatgtcccagctctcttctgtgtcccaccattagaaaatcaaaagctgactntagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaanatacaccnttgatcatantgtntctcnancaaaagcttcaatggtcaagtactgaacnttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 4686 - DNA, 311 bp, Artificial Sequence
  Description of Artificial Sequence: Synthetic polynucleotide
  modified_base (39)..(39): a, c, t, g, unknown or other
  modified_base (72)..(72): a, c, t, g, unknown or other
  modified_base (90)..(90): a, c, t, g, unknown or other
  modified_base (107)..(107): a, c, t, g, unknown or other
  modified_base (198)..(198): a, c, t, g, unknown or other
  modified_base (204)..(204): a, c, t, g, unknown or other
  modified_base (211)..(211): a, c, t, g, unknown or other
  modified_base (222)..(222): a, c, t, g, unknown or other
  modified_base (235)..(235): a, c, t, g, unknown or other
  modified_base (284)..(284): a, c, t, g, unknown or other
  modified_base (292)..(292): a, c, t, g, unknown or other
aagaatagataascttaaggtagggaggctttttaaatnggaaagaagccccagctagaggctcaaagacantaaataaaaaaccacagnaagtcagtaaaattagntatataatgttaaaacyaacattattcacattatggtatgtaaatgacattatataatacttagttttggtcatcaayatggtggtcattntgcacntctgaanttaagagaganaggaaatatatanaagagttgagaaatggggatgaattctacttctggtaaggtagggctgnatactttnaaccaatattcctactaaa

SEQ ID NO: 4687 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtkgtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4688 - DNA, 250 bp, Artificial Sequence
  Description of Artificial Sequence: Synthetic polynucleotide
  modified_base (14)..(49): a, c, t, g, unknown or other
  modified_base (51)..(51): a, c, t, g, unknown or other
  modified_base (110)..(110): a, c, t, g, unknown or other
  modified_base (160)..(160): a, c, t, g, unknown or other
  modified_base (218)..(218): a, c, t, g, unknown or other
cacatcatgtatannnnnnnnnnnnnnnnnnnnnnnnnnnnnnnnnnnntnctttagaaaagagactaaattctttaaaatattttacatagtccttaaaatttgtyttngattttcgcttcactcttattactctctcaccattaccctaaactcaatnggagttctaattccaagaaacattcatagctccttgatgtgtgcactctcatttccangtctctgaaaatgtttctttcacragtttctc

SEQ ID NO: 4689 - DNA, 370 bp, Artificial Sequence
  Description of Artificial Sequence: Synthetic polynucleotide
  modified_base (24)..(24): a, c, t, g, unknown or other
  modified_base (30)..(30): a, c, t, g, unknown or other
  modified_base (103)..(103): a, c, t, g, unknown or other
  modified_base (131)..(131): a, c, t, g, unknown or other
  modified_base (135)..(135): a, c, t, g, unknown or other
  modified_base (175)..(175): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (351)..(351): a, c, t, g, unknown or other
taaaagagggaagatgacttttcntaaagngtggaataaagaaaagtaagatagcggatagaagcttgaagtgaaagcaggttcacaggaagtttctttggtntttgttttgtttttaaatagtggaaagntgtntatgtttatggagaaagattgccttgaagatgcaagaggnagagatgatcaaaattcaagaagmagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 4690 - DNA, 149 bp, Artificial Sequence
  Description of Artificial Sequence: Synthetic polynucleotide
  modified_base (10)..(10): a, c, t, g, unknown or other
  modified_base (12)..(12): a, c, t, g, unknown or other
  modified_base (36)..(36): a, c, t, g, unknown or other
  modified_base (125)..(125): a, c, t, g, unknown or other
  modified_base (137)..(137): a, c, t, g, unknown or other
  modified_base (144)..(144): a, c, t, g, unknown or other
ctcccaagtnanaaaagttccttttttccccattancttcctgtagacaaccatgggaaaatgtacayccagtatacagttattgtaaatagccagacccagtactatgccaatcagagtaaacnaccctcagtttnaaaagantggat

SEQ ID NO: 4691 - DNA, 279 bp, Artificial Sequence
  Description of Artificial Sequence: Synthetic polynucleotide
  modified_base (32)..(32): a, c, t, g, unknown or other
  modified_base (82)..(82): a, c, t, g, unknown or other
  modified_base (101)..(101): a, c, t, g, unknown or other
  modified_base (150)..(150): a, c, t, g, unknown or other
  modified_base (256)..(256): a, c, t, g, unknown or other
  modified_base (266)..(266): a, c, t, g, unknown or other
tttaactgattatctttttctaagccacatgntaagatgttcttgtctgtctttcagttaggactttatttttacttttaanttcagagcttcttgatggntgttctttctaaataattattatttagcaactgactgtcataagagatncaaaatacatcaaatatctaacasaaaatrtaaaatatgyagtaatcttagccctcaaggaaacccagatttcccaattctgagtatattgttcaagttccttttncaggacagcncaaggttctgtca

SEQ ID NO: 4692 - DNA, 243 bp, Artificial Sequence
  Description of Artificial Sequence: Synthetic polynucleotide
  modified_base (20)..(20): a, c, t, g, unknown or other
  modified_base (25)..(25): a, c, t, g, unknown or other
  modified_base (36)..(36): a, c, t, g, unknown or other
  modified_base (40)..(40): a, c, t, g, unknown or other
  modified_base (64)..(64): a, c, t, g, unknown or other
  modified_base (69)..(69): a, c, t, g, unknown or other
  modified_base (107)..(107): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (180)..(180): a, c, t, g, unknown or other
  modified_base (201)..(201): a, c, t, g, unknown or other
  misc_feature (210)..(210): May or may not be present
agactcatcaacttctcatnatcyntactaccacanacancagaatatctaaaacccctagagnccaanccactccagtccatgtttgagttttccaaatccacatncatttgaagngtngaattttccatgcantgtgttttgaaatcaacagacatatacttaatccttttgcctcantttctgatcatcataaagaynggaaaaacagaaatcctcagttcattttaattctcttagtcc

SEQ ID NO: 4693 - DNA, 308 bp, Artificial Sequence
  Description of Artificial Sequence: Synthetic polynucleotide
  modified_base (35)..(35): a, c, t, g, unknown or other
  modified_base (63)..(63): a, c, t, g, unknown or other
  modified_base (73)..(73): a, c, t, g, unknown or other
  modified_base (81)..(81): a, c, t, g, unknown or other
  modified_base (173)..(173): a, c, t, g, unknown or other
  misc_feature (220)..(220): May or may not be present
  modified_base (261)..(261): a, c, t, g, unknown or other
  modified_base (272)..(272): a, c, t, g, unknown or other
  modified_base (304)..(304): a, c, t, g, unknown or other
tatatcaactggtaaaactttattttacaagcaanaggaattggatcaaatgattattataanccagaggaantattttgnaaccacagcaaatgccattatacatactgccaatacasatttaatagacaatactgaactgtacaagagttatttatttttccttaatctcnaagcyatttttagtaatacaaaaaagccatattaacatttttttcccgttagaaaacatgatgtacaaaactttggatgaraagatangtcaaatttcntttaatcacttggaggaaaatccaccaactcntcaa

SEQ ID NO: 4694 - DNA, 299 bp, Artificial Sequence
  Description of Artificial Sequence: Synthetic polynucleotide
  modified_base (22)..(22): a, c, t, g, unknown or other
  modified_base (62)..(62): a, c, t, g, unknown or other
  modified_base (133)..(133): a, c, t, g, unknown or other
  modified_base (170)..(170): a, c, t, g, unknown or other
  modified_base (172)..(172): a, c, t, g, unknown or other
  modified_base (205)..(205): a, c, t, g, unknown or other
  modified_base (252)..(252): a, c, t, g, unknown or other
  modified_base (256)..(256): a, c, t, g, unknown or other
  modified_base (286)..(286): a, c, t, g, unknown or other
  modified_base (294)..(294): a, c, t, g, unknown or other
ctggtacacagcctcaggaccncagctgaatgcacagctagaaggttggctttcacaagtanagtctacaaaaagacctgctagagccattattgcmccccatgcaggatatacgtactktgggtcttgtgcncccatgcttataaacaagtggatcyrtctattacccngngaattttyatccttgggcyttctcatcatgtgnccctctctcsrtgtgcactttccagtgtggatatatataggacaccnctgnatgaccttcgtattgaccaaaagatttacngagaactntggaa

SEQ ID NO: 4695 - DNA, 400 bp, Artificial Sequence
  Description of Artificial Sequence: Synthetic polynucleotide
  modified_base (88)..(88): a, c, t, g, unknown or other
  modified_base (90)..(90): a, c, t, g, unknown or other
  modified_base (139)..(139): a, c, t, g, unknown or other
  modified_base (205)..(205): a, c, t, g, unknown or other
attgacacggaaaggcaaaaagactttctggattatgaaaaaacatgatatccaacaaatcttgattgcccatgtaaatcttgattgncnatgtaatgtttagtttgtattctttaagccatgtcataagtatatctcntcattgtagtcacacagtttgtcatatcattcttgaaatacttccttctcattygagtcatattcntcaacataaytccagggtttactccagtttttccacagtatggttgcctagcaaagcgactataccatcttatttgaggttccttgtgttctgaggccactggagcaatttatgtggaattaaatttctttagtaaagaacaaatatgatcaactggtcgtaaaaaaggctattagtgtgggagtmaacttcttt

SEQ ID NO: 4696 - DNA, 100 bp, Artificial Sequence
  Description of Artificial Sequence: Synthetic polynucleotide
  modified_base (8)..(8): a, c, t, g, unknown or other
  modified_base (13)..(13): a, c, t, g, unknown or other
  modified_base (18)..(18): a, c, t, g, unknown or other
  modified_base (43)..(43): a, c, t, g, unknown or other
  modified_base (52)..(52): a, c, t, g, unknown or other
  modified_base (79)..(79): a, c, t, g, unknown or other
ttctgcangccancaccnagtcccacaggcgcctacctgcccnataagaggntccctgccatttctctagtctsccccnttcaacagcacaccaaataag

SEQ ID NO: 4697 - DNA, 174 bp, Artificial Sequence
  Description of Artificial Sequence: Synthetic polynucleotide
  modified_base (5)..(5): a, c, t, g, unknown or other
  modified_base (22)..(22): a, c, t, g, unknown or other
  modified_base (33)..(33): a, c, t, g, unknown or other
  modified_base (41)..(41): a, c, t, g, unknown or other
  modified_base (44)..(44): a, c, t, g, unknown or other
  modified_base (47)..(47): a, c, t, g, unknown or other
  modified_base (49)..(49): a, c, t, g, unknown or other
  modified_base (97)..(97): a, c, t, g, unknown or other
  modified_base (100)..(100): a, c, t, g, unknown or other
  modified_base (103)..(103): a, c, t, g, unknown or other
  modified_base (117)..(117): a, c, t, g, unknown or other
  modified_base (138)..(138): a, c, t, g, unknown or other
  modified_base (153)..(153): a, c, t, g, unknown or other
  modified_base (166)..(166): a, c, t, g, unknown or other
  modified_base (172)..(172): a, c, t, g, unknown or other
ggggnaaaagttagatygggtnattggagttanaggagagnggnacngngcaaggattccagtactggagaatgtctrgtttactgtagccaagatnttntantttagggcataatntaaaatgctcccttgactccnccaccccatggaagntctcaggttgagnggcccngc

SEQ ID NO: 4698 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (82)..(82): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaanggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacyacagattcctcagccttttananaancttggaggagcnctggggtcttattccaggagaaaancaaatnaatctncatntttccncttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 4699 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccyctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4700 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcwtccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4701 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
  modified_base (1487)..(1487): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatyaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaanccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4702 - DNA, 1545 bp, Artificial Sequence
  Description of Artificial Sequence: Synthetic polynucleotide
  modified_base (2)..(2): a, c, t, g, unknown or other
  modified_base (37)..(37): a, c, t, g, unknown or other
  modified_base (44)..(44): a, c, t, g, unknown or other
  modified_base (67)..(67): a, c, t, g, unknown or other
  modified_base (70)..(70): a, c, t, g, unknown or other
  modified_base (117)..(168): a, c, t, g, unknown or other
  modified_base (170)..(170): a, c, t, g, unknown or other
  modified_base (172)..(172): a, c, t, g, unknown or other
  modified_base (176)..(176): a, c, t, g, unknown or other
  modified_base (178)..(178): a, c, t, g, unknown or other
  modified_base (184)..(184): a, c, t, g, unknown or other
  modified_base (189)..(189): a, c, t, g, unknown or other
  modified_base (226)..(226): a, c, t, g, unknown or other
  modified_base (236)..(236): a, c, t, g, unknown or other
  modified_base (240)..(240): a, c, t, g, unknown or other
  modified_base (275)..(275): a, c, t, g, unknown or other
  modified_base (282)..(282): a, c, t, g, unknown or other
  modified_base (529)..(529): a, c, t, g, unknown or other
  modified_base (574)..(574): a, c, t, g, unknown or other
  modified_base (666)..(666): a, c, t, g, unknown or other
  modified_base (757)..(757): a, c, t, g, unknown or other
  modified_base (841)..(841): a, c, t, g, unknown or other
  modified_base (846)..(846): a, c, t, g, unknown or other
  modified_base (870)..(870): a, c, t, g, unknown or other
  modified_base (873)..(873): a, c, t, g, unknown or other
  modified_base (917)..(917): a, c, t, g, unknown or other
  modified_base (947)..(947): a, c, t, g, unknown or other
  modified_base (968)..(968): a, c, t, g, unknown or other
  modified_base (1023)..(1023): a, c, t, g, unknown or other
  modified_base (1040)..(1040): a, c, t, g, unknown or other
  modified_base (1126)..(1126): a, c, t, g, unknown or other
  modified_base (1275)..(1275): a, c, t, g, unknown or other
  modified_base (1340)..(1340): a, c, t, g, unknown or other
  modified_base (1453)..(1453): a, c, t, g, unknown or other
  modified_base (1476)..(1476): a, c, t, g, unknown or other
  modified_base (1492)..(1492): a, c, t, g, unknown or other
tntgttttaaattgttaatatcgcttattttttaaantgttggnaaatttaaattagctctttagangancagagcaatttaaatgattaaaatcagttttgtttagacttctttcnnnnnnnnnnnnnnnnnnnnnnnnnnnnnnnnnnnnnnnnnnnnnnnnnnnnananatantnataaangttanatatccagtaatttttttaagtatgatgaagtcactngaatgaatanagcnaaaatatgaacaacctctattatattacacaaacntttagcncctagtaatagggtscctcttaaacccaatacacagctttgaattgaaatgaaaacttacttgcagttctggcacactttgcactcaggacattgccaacctgcacgttttaawggagtaaccgctrtatccaggcacattccatgatagtgctgaccacaagtagtacaaaagaactgatctaagaggtctccygggctgtcgcacactgcacagtttgcatcttccttcgctataattaacagtnaaacaatgaaattgttgtataagaatttaaattttttctgactanacagtaaaatcatttgaaaggatttgcatcatgaacctttcagacatttgaagttattcacattgaattgtcatctaatcagaaagaggtancaataaaaacactgtagggtatttaatctaaatgtaaccacattaaatttaatcgtatagttttgcaattatttgtggctatatctacttnagaccataagcaggtcttctttaattttctattcctaatgccaatgataatgctggatacctaattaatgctcaatatatgctnactgnaaagaaccaaacaaggaaaatacnaantaagaaatgctttgcagtgtaacataaacattttctttgaatgntaaatatattttgaaattacaaaatcaganaagagacaaaattaagaaacnttaatatcaattagactaagatgcttcttaagcataaacagactattcaaatcanataagggcttttttttnattactggaaaatgycttatgtggaagaacattaaagacagaagctacatattcatacacaaacacattacttaatatactaattntatattcatctatattaatttctagttgtaaaagcattaaaatccacataattatggacatcatccatccctaaatgtggattaaaagaaaatgtactaacagttcttttaccatataaaacagaaaatataaggataaactgccctgncaaatatacagttaaacttatgcataytgcaaaataaggaaaataatgtattctaaaatcatacnaatcttagataatgtataaaaaatatgcctgtatataacaagtatcacaaagtatatgaatcttttcattttttgaaggtttgatcattcctatctactattctgactcatangttctttcttttccagtcaagcntatcataccaaccttngataatatatataaatatgcctgtatttaacaagtatcacaaagtatatgaac

SEQ ID NO: 4703 - DNA, 174 bp, Artificial Sequence
  Description of Artificial Sequence: Synthetic polynucleotide
  modified_base (18)..(18): a, c, t, g, unknown or other
  modified_base (48)..(48): a, c, t, g, unknown or other
  modified_base (68)..(68): a, c, t, g, unknown or other
  modified_base (86)..(86): a, c, t, g, unknown or other
  modified_base (104)..(104): a, c, t, g, unknown or other
  modified_base (125)..(125): a, c, t, g, unknown or other
  modified_base (128)..(128): a, c, t, g, unknown or other
  modified_base (140)..(140): a, c, t, g, unknown or other
  modified_base (142)..(142): a, c, t, g, unknown or other
ctaatgcttttgctactncagagtcaaatgcccrcttttcttccagcntttgtttctvcaaggctaangtgatgtgctgcttttcngtggccttctgttctgcnagctctctgttcagctgatcnatngacgatgtgcangngcaatsagggagttcagatcatcagtagagag

SEQ ID NO: 4704 - DNA, 108 bp, Artificial Sequence
  Description of Artificial Sequence: Synthetic polynucleotide
  modified_base (90)..(90): a, c, t, g, unknown or other
aataaataaataagtataatattttggcattcaaaaaattktcagattatgttgtttctcttttatacatattttaatacaaattttttnatcccaaccttgccccag

SEQ ID NO: 4705 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatragtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4706 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcrgattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4707 - DNA, 175 bp, Artificial Sequence
  Description of Artificial Sequence: Synthetic polynucleotide
  modified_base (9)..(9): a, c, t, g, unknown or other
  modified_base (20)..(20): a, c, t, g, unknown or other
  modified_base (44)..(44): a, c, t, g, unknown or other
  modified_base (56)..(56): a, c, t, g, unknown or other
  modified_base (102)..(102): a, c, t, g, unknown or other
  modified_base (106)..(106): a, c, t, g, unknown or other
  modified_base (135)..(135): a, c, t, g, unknown or other
  modified_base (142)..(142): a, c, t, g, unknown or other
  modified_base (154)..(154): a, c, t, g, unknown or other
  modified_base (160)..(160): a, c, t, g, unknown or other
ttgagaagntaccattgtcngcyatgcttttaaagacatcaggnccattcttgctncttctgatgaaaccaaatcygattaaaaaccaaaataccacttctntatncaagggtctaactattttggactgaaagnaaaaatngtaattggatgnccagtnartgaccaattaatg

SEQ ID NO: 4708 - DNA, 1484 bp, Artificial Sequence
  Description of Artificial Sequence: Synthetic polynucleotide
  modified_base (66)..(66): a, c, t, g, unknown or other
  modified_base (133)..(133): a, c, t, g, unknown or other
  modified_base (142)..(142): a, c, t, g, unknown or other
  modified_base (214)..(214): a, c, t, g, unknown or other
  modified_base (267)..(267): a, c, t, g, unknown or other
  modified_base (329)..(329): a, c, t, g, unknown or other
  modified_base (353)..(353): a, c, t, g, unknown or other
  modified_base (416)..(416): a, c, t, g, unknown or other
  modified_base (637)..(637): a, c, t, g, unknown or other
  modified_base (646)..(646): a, c, t, g, unknown or other
  modified_base (684)..(684): a, c, t, g, unknown or other
  modified_base (703)..(703): a, c, t, g, unknown or other
  modified_base (722)..(722): a, c, t, g, unknown or other
  modified_base (935)..(935): a, c, t, g, unknown or other
  modified_base (984)..(984): a, c, t, g, unknown or other
  modified_base (1022)..(1022): a, c, t, g, unknown or other
  modified_base (1052)..(1052): a, c, t, g, unknown or other
  modified_base (1127)..(1127): a, c, t, g, unknown or other
  modified_base (1203)..(1203): a, c, t, g, unknown or other
  modified_base (1299)..(1299): a, c, t, g, unknown or other
  modified_base (1343)..(1343): a, c, t, g, unknown or other
  modified_base (1366)..(1366): a, c, t, g, unknown or other
  modified_base (1376)..(1376): a, c, t, g, unknown or other
  modified_base (1476)..(1476): a, c, t, g, unknown or other
  modified_base (1482)..(1482): a, c, t, g, unknown or other
attttagtatatasgttctaatatttggggtattcctagaaatgtgtacctattattcacttgctnatatatatagcaaagtgaattttatatataattcttcaacatatttttagaaaaattaagttttttntagaaaatnaagagaattttagataaaaactcaacttttaatggaaaatattktcctttttctttctcacatgaaatyctntatcaaggttagtatcctacctggyatctctccaatastgggttaagagtttnttcttctcaagtaacctgtattatattaagatgatattaactgaaataatcagatagatgantgcrycataaagctaattctaagntatctgtccttagccaaaagcagaaaagggatacacataactyccacataaaacatccacccncatttttttggttattcttaaaagctcataatgtatacaatgataaaatttattgtttcaaattagggtttttgaaattgaaatattaatttaaacacgtttgcttaacacaactttaaagttaataagaaaacactgchtattacagaagagttaaatacttcaaaaagtgggaaaraatttaaaagctttcatttkagtaggagtaaacacagacacantaagaatcntagttggatacactkaaatcatgtcttttaagaacatnagaacagattatttgcttnctctttagtccaaaacctnggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaagktgagtcaataaggtgaaccagattctggttgaatggaatccttgaaanataactttggtgaacaaactgtttgtgttttccacttttcttaaaaaangaagtgataaagcagatttccagtacctgccarctganaaaatgytacttaccaggtaaaaaccaytnccaaaaatcagaatcacagaagggctatcagtaaaaytaytaatgccacaaattaacatgatgttaacwgctganttatgcatcaaaagagtatttatataatcacagcaaataactcaaatcttttacatcactagtaaactcaaaaaanatagmaaaaagcaataacattaaatttcmttattgatctactagctttaactatttaatactagtacacttagttttgattactttgaaattgaancaaaaacaataatcttttcttcttttaatgactttttcagttanaggaaagatgatattaaaagaanatatacaacnatagcttagctacaggtataaaaytgttttaaagatatgtaattgtgctattgaattaaactgaaaacataaatatcaactcatgattttgaaaaaaaantctttnat

SEQ ID NO: 4709 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  misc_feature (159)..(159): May or may not be present
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaaagttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4710 - DNA, 453 bp, Artificial Sequence
  Description of Artificial Sequence: Synthetic polynucleotide
  modified_base (43)..(43): a, c, t, g, unknown or other
  modified_base (52)..(52): a, c, t, g, unknown or other
  modified_base (54)..(54): a, c, t, g, unknown or other
  modified_base (57)..(57): a, c, t, g, unknown or other
  modified_base (74)..(378): a, c, t, g, unknown or other
  modified_base (382)..(382): a, c, t, g, unknown or other
  modified_base (390)..(390): a, c, t, g, unknown or other
  modified_base (428)..(428): a, c, t, g, unknown or other
agatatttttaaatgggaaaacaacttactttcaacaayttantttttccanancangttactatgttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatngacagtanattcatttaatctggcaattttaatttsaacaaatacntattaacaacaaattaaatcctatt

SEQ ID NO: 4711 - DNA, 125 bp, Artificial Sequence
  Description of Artificial Sequence: Synthetic polynucleotide
  modified_base (34)..(34): a, c, t, g, unknown or other
  modified_base (51)..(51): a, c, t, g, unknown or other
  modified_base (56)..(56): a, c, t, g, unknown or other
  modified_base (71)..(71): a, c, t, g, unknown or other
  modified_base (101)..(101): a, c, t, g, unknown or other
tagggcgctggagagcggggatcctctggtrccngagtcaatggatccacnggtcngggtcctcccatgtnttagccccgggaggggagaggcgggggtcntcctttgccctagtccaaggcatt

SEQ ID NO: 4712 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcmtgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4713 - DNA, 176 bp, Artificial Sequence
  Description of Artificial Sequence: Synthetic polynucleotide
  modified_base (12)..(12): a, c, t, g, unknown or other
  modified_base (35)..(35): a, c, t, g, unknown or other
  modified_base (67)..(67): a, c, t, g, unknown or other
  modified_base (84)..(84): a, c, t, g, unknown or other
  modified_base (113)..(113): a, c, t, g, unknown or other
  modified_base (120)..(120): a, c, t, g, unknown or other
  modified_base (126)..(126): a, c, t, g, unknown or other
  modified_base (145)..(145): a, c, t, g, unknown or other
  modified_base (151)..(151): a, c, t, g, unknown or other
  modified_base (156)..(156): a, c, t, g, unknown or other
  modified_base (174)..(174): a, c, t, g, unknown or other
ggaagggaaaantcaatatcttacagtacagtttncaytctaagaaatactacacattttatgttanaagcaaaattttatggnatagtttatgaaataaaattgaacctcanagttttnaatttntttgtacaataatgtttcntttagncactnccccatcctccttttaanta

SEQ ID NO: 4714 - DNA, 793 bp, Artificial Sequence
  Description of Artificial Sequence: Synthetic polynucleotide
  modified_base (9)..(9): a, c, t, g, unknown or other
  modified_base (61)..(61): a, c, t, g, unknown or other
  modified_base (110)..(110): a, c, t, g, unknown or other
  modified_base (112)..(112): a, c, t, g, unknown or other
  modified_base (125)..(125): a, c, t, g, unknown or other
  modified_base (155)..(155): a, c, t, g, unknown or other
  modified_base (162)..(162): a, c, t, g, unknown or other
  modified_base (197)..(197): a, c, t, g, unknown or other
  modified_base (208)..(208): a, c, t, g, unknown or other
  modified_base (218)..(218): a, c, t, g, unknown or other
  modified_base (229)..(229): a, c, t, g, unknown or other
  modified_base (240)..(240): a, c, t, g, unknown or other
  modified_base (251)..(251): a, c, t, g, unknown or other
  modified_base (256)..(256): a, c, t, g, unknown or other
  modified_base (277)..(277): a, c, t, g, unknown or other
  modified_base (281)..(281): a, c, t, g, unknown or other
  modified_base (302)..(302): a, c, t, g, unknown or other
  modified_base (315)..(315): a, c, t, g, unknown or other
  modified_base (328)..(328): a, c, t, g, unknown or other
  modified_base (343)..(343): a, c, t, g, unknown or other
  modified_base (349)..(349): a, c, t, g, unknown or other
  modified_base (361)..(361): a, c, t, g, unknown or other
  modified_base (389)..(389): a, c, t, g, unknown or other
  modified_base (401)..(401): a, c, t, g, unknown or other
  modified_base (412)..(412): a, c, t, g, unknown or other
  modified_base (435)..(435): a, c, t, g, unknown or other
  modified_base (474)..(474): a, c, t, g, unknown or other
  modified_base (487)..(487): a, c, t, g, unknown or other
  modified_base (496)..(496): a, c, t, g, unknown or other
  modified_base (518)..(518): a, c, t, g, unknown or other
  modified_base (533)..(533): a, c, t, g, unknown or other
  modified_base (542)..(542): a, c, t, g, unknown or other
  modified_base (552)..(552): a, c, t, g, unknown or other
  modified_base (601)..(601): a, c, t, g, unknown or other
  modified_base (608)..(608): a, c, t, g, unknown or other
  modified_base (619)..(619): a, c, t, g, unknown or other
  modified_base (625)..(625): a, c, t, g, unknown or other
  modified_base (633)..(633): a, c, t, g, unknown or other
  modified_base (638)..(638): a, c, t, g, unknown or other
  modified_base (641)..(641): a, c, t, g, unknown or other
  modified_base (643)..(643): a, c, t, g, unknown or other
  modified_base (655)..(655): a, c, t, g, unknown or other
  modified_base (682)..(682): a, c, t, g, unknown or other
  modified_base (698)..(698): a, c, t, g, unknown or other
  modified_base (723)..(723): a, c, t, g, unknown or other
  modified_base (752)..(752): a, c, t, g, unknown or other
  modified_base (759)..(759): a, c, t, g, unknown or other
  modified_base (785)..(785): a, c, t, g, unknown or other
aaagttctncttactagaaaaaaggattgtgaattcttcccacttctcacttatcatctgntaagcattttgcagatakgacatctagatatgggaaaacataagaaaantntccaattacttangtgtcctccaatccttggaaggcactcagnctgatanaagtgagttctttgacataatattttgcawaactnaagttcaaacnttattgtttntaacatctatncatctatatgnaagcaatayyntatgncaggaacaagtttctattatngatntgaatttgtcctcccttagcnagaaagatcattnatctaggccagangagaattgctgttanattctnagcataggagcncttacctgattcatgaattataagttgnattccatatccnactgtatttgngttcttatctattcagatctttnttgkttttgtatattaacatgttttctctcactgtactngaaatctttttgntcccttttntattaaaggcatttgttgcacnctccttggctggccntcctcccanctccatcccntccaattatgttygtaacttcctgacatataaatgttgatagtagtatnaaaaganattatctagtntaatanactgtcanatatnagntntttttgctactnctttcttacaacctatgactctygagnctttgaaagcctaatnaaactattggcaattctgtaattcnttactttgtactctacagtgcttgtttanctcttanggggtttgttctattaaattacactncataataa

SEQ ID NO: 4715 - DNA, 597 bp, Artificial Sequence
  Description of Artificial Sequence: Synthetic polynucleotide
  modified_base (18)..(18): a, c, t, g, unknown or other
  modified_base (37)..(37): a, c, t, g, unknown or other
  modified_base (41)..(41): a, c, t, g, unknown or other
  modified_base (55)..(55): a, c, t, g, unknown or other
  modified_base (57)..(57): a, c, t, g, unknown or other
  modified_base (65)..(65): a, c, t, g, unknown or other
  modified_base (67)..(67): a, c, t, g, unknown or other
  modified_base (75)..(75): a, c, t, g, unknown or other
  modified_base (98)..(98): a, c, t, g, unknown or other
  modified_base (106)..(106): a, c, t, g, unknown or other
  modified_base (142)..(142): a, c, t, g, unknown or other
  modified_base (164)..(164): a, c, t, g, unknown or other
  modified_base (176)..(176): a, c, t, g, unknown or other
  modified_base (226)..(226): a, c, t, g, unknown or other
  modified_base (268)..(268): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (326)..(326): a, c, t, g, unknown or other
  modified_base (329)..(329): a, c, t, g, unknown or other
  modified_base (375)..(375): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
  modified_base (432)..(432): a, c, t, g, unknown or other
  modified_base (457)..(457): a, c, t, g, unknown or other
  modified_base (549)..(549): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
attaaaagaaattggtanagaaaggaagtataatycnaaanatattactaaaacnanccagagananttttccantgtccaacatgttcctaatacancaagtcanaattcataatgacttggacggtcaaaaggagaatgntaacttttgaaaatgaaagccntggacattctgngtaggtgtttggcacccaaaatttcactgaagaagaatgctgtttcttantatcaaaccaaagtgcaaagcaatataaattagaggccaagncttctcttgncgntcnatttacttctgtaaaacagattctatgttccttttctatgancantttacatttgaaacattagattttttcactratgagggaaggaaangggcttctgtnctacttnaagncngngaagctaaggtctccttctcaaagnagagcnggaatcagaggtgagaaatgtcggnacttgaagagttaggctgctttgcatctacccagcgtctagaaccaattccagcttcataactcagctgtgaacgaactcccttaggcattnggtagccacgtagccagtagttcaagactagaaaacccngangrnaaa

SEQ ID NO: 4716 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggktttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4717 - DNA, 150 bp, Artificial Sequence
  Description of Artificial Sequence: Synthetic polynucleotide
tcagctccttcaggtgggttaaaatgttatatttaactgacaatagtgaaattggttgaaggcaatagaataaagggagattttgcgacttttcctgggtccatattgtgatyctgagtctgggtgtgagctttccagtgtttctgaact

SEQ ID NO: 4718 - DNA, 177 bp, Artificial Sequence
  Description of Artificial Sequence: Synthetic polynucleotide
  modified_base (26)..(26): a, c, t, g, unknown or other
  modified_base (56)..(56): a, c, t, g, unknown or other
  modified_base (74)..(74): a, c, t, g, unknown or other
  modified_base (87)..(87): a, c, t, g, unknown or other
  modified_base (98)..(98): a, c, t, g, unknown or other
  modified_base (100)..(100): a, c, t, g, unknown or other
  modified_base (139)..(139): a, c, t, g, unknown or other
  modified_base (161)..(161): a, c, t, g, unknown or other
tcygaaatgcmcagtgcttktacatngtgagggyakcacacctggttgtcagcacngcatcacctctgagatgncctcccgttcacntgtgtagcaananaaaargtctggcttaacaactgtcattctcagctcccancaaagcagaatagggtgttgtnctcatatttaaagctt

SEQ ID NO: 4719 - DNA, 243 bp, Artificial Sequence
  Description of Artificial Sequence: Synthetic polynucleotide
  modified_base (20)..(20): a, c, t, g, unknown or other
  modified_base (25)..(25): a, c, t, g, unknown or other
  modified_base (36)..(36): a, c, t, g, unknown or other
  modified_base (40)..(40): a, c, t, g, unknown or other
  modified_base (64)..(64): a, c, t, g, unknown or other
  modified_base (107)..(107): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (180)..(180): a, c, t, g, unknown or other
  modified_base (201)..(201): a, c, t, g, unknown or other
  modified_base (210)..(210): a, c, t, g, unknown or other
agactcatcaacttctcatnatcyntactaccacanacancagaatatctaaaacccctagagnccaayccactccagtccatgtttgagttttccaaatccacatncatttgaagngtngaattttccatgcantgtgttttgaaatcaacagacatatacttaatccttttgcctcantttctgatcatcataaagaynggaaaaacngaaatcctcagttcattttaattctcttagtcc

SEQ ID NO: 4720 - DNA, 102 bp, Artificial Sequence
  Description of Artificial Sequence: Synthetic polynucleotide
  modified_base (8)..(8): a, c, t, g, unknown or other
  modified_base (13)..(13): a, c, t, g, unknown or other
  modified_base (18)..(18): a, c, t, g, unknown or other
  misc_feature (43)..(45): This region may encompass 'tac' or 'cgg'
  modified_base (54)..(54): a, c, t, g, unknown or other
  modified_base (76)..(76): a, c, t, g, unknown or other
  modified_base (81)..(81): a, c, t, g, unknown or other
ttctgcangccancaccnagtcccacaggcgcctacctgcccyrsataagaggntccctgccatttctctagtctnccccnttcaacagcacaccaaataag

SEQ ID NO: 4721 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgsccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4722 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccygttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4723 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatytccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4724 - DNA, 308 bp, Artificial Sequence
  Description of Artificial Sequence: Synthetic polynucleotide
  modified_base (35)..(35): a, c, t, g, unknown or other
  modified_base (63)..(63): a, c, t, g, unknown or other
  modified_base (73)..(73): a, c, t, g, unknown or other
  modified_base (173)..(173): a, c, t, g, unknown or other
  modified_base (220)..(220): a, c, t, g, unknown or other
  modified_base (261)..(261): a, c, t, g, unknown or other
  modified_base (272)..(272): a, c, t, g, unknown or other
  modified_base (304)..(304): a, c, t, g, unknown or other
tatatcaactggtaaaactttattttacaagcaanaggaattggatcaaatgattattataanccagaggaantattttgkaaccacagcaaatgccattatacatactgccaatacasatttaatagacaatactgaactgtacaagagttatttatttttccttaatctcnaagcyatttttagtaatacaaaaaagccatattaacatttttttccngttagaaaacatgatgtacaaaactttggatgaraagatangtcaaatttcntttaatcacttggaggaaaatccaccaactcntcaa

SEQ ID NO: 4725 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtmttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4726 - DNA, 170 bp, Artificial Sequence
  Description of Artificial Sequence: Synthetic polynucleotide
  modified_base (35)..(35): a, c, t, g, unknown or other
  modified_base (77)..(77): a, c, t, g, unknown or other
  modified_base (105)..(105): a, c, t, g, unknown or other
  modified_base (117)..(117): a, c, t, g, unknown or other
  modified_base (134)..(134): a, c, t, g, unknown or other
cccatttttattaattattgaatctggttggattnccayataatgtcttttcatactgctttgcaatacttcagacntacttgtatggaatctgaacattaatgnttcccatcaggntgaaagaataaagggantaagatagtacactcttgaattacaagctaagtctt

SEQ ID NO: 4727 - DNA, 3640 bp, Artificial Sequence
  Description of Artificial Sequence: Synthetic polynucleotide
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggktattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4728 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcamtacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4729 - DNA, 434 bp, Artificial Sequence
  Description of Artificial Sequence: Synthetic polynucleotide
  modified_base (54)..(54): a, c, t, g, unknown or other
  modified_base (62)..(62): a, c, t, g, unknown or other
  modified_base (71)..(71): a, c, t, g, unknown or other
  modified_base (119)..(119): a, c, t, g, unknown or other
  modified_base (129)..(129): a, c, t, g, unknown or other
  modified_base (134)..(134): a, c, t, g, unknown or other
  modified_base (164)..(164): a, c, t, g, unknown or other
  modified_base (166)..(166): a, c, t, g, unknown or other
  modified_base (168)..(168): a, c, t, g, unknown or other
  modified_base (175)..(175): a, c, t, g, unknown or other
  modified_base (199)..(199): a, c, t, g, unknown or other
  modified_base (235)..(235): a, c, t, g, unknown or other
  modified_base (245)..(245): a, c, t, g, unknown or other
  modified_base (253)..(253): a, c, t, g, unknown or other
  modified_base (265)..(265): a, c, t, g, unknown or other
  modified_base (267)..(267): a, c, t, g, unknown or other
  modified_base (288)..(288): a, c, t, g, unknown or other
  modified_base (305)..(305): a, c, t, g, unknown or other
  modified_base (307)..(307): a, c, t, g, unknown or other
  modified_base (395)..(395): a, c, t, g, unknown or other
  modified_base (406)..(430): a, c, t, g, unknown or other
gctttctctctctggttctcagatgaggaaygatgataaaacaaaaccaaaagncrtcttantgaggaagntcagctccagtggatttctytgagacaacccaagttagatggagctangggaaaaaanacagnaattctttaaactatcattcaagcaaaacntntnrcctaantgttccttttaaagtagctagacntgttagagattttattgagtggatataagcactttntacagaaacntttttttnaaaaatgtacancncttttcatagaacagaggaanagctgtcacatcagttncngatgccragcacagcaatataaagtatatmccctacgagttagatgaagcagaggaaagggatcaagagattaatatacctctttganaaaagcacccnnnnnnnnnnnnnnnnnnnnnnnnngcaa

SEQ ID NO: 4730 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  modified_base (89)..(89): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (154)..(154): a, c, t, g, unknown or other
  modified_base (198)..(198): a, c, t, g, unknown or other
  modified_base (226)..(226): a, c, t, g, unknown or other
  modified_base (243)..(243): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctacttncaagttctttccccaaacttttctcacctatgtttkcctatggggctntngaytcagnttcatgngcaatgtgttcctataaagaagaaggagtgtagggycaccttcngcttatgttttagctctagaggatgagngaagagccaacgtgtgncagtttgaggatggatgtacagtgagtagtgaggggctttttccaccttgaanrcatgagngctcttgagnccctcccactgnanttcagagtcaccagatntgtgcatgatatctctgc

SEQ ID NO: 4731 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagrccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4732 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1729)..(1729): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacrccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4733 - DNA, 201 bp, Artificial Sequence
  Description of Artificial Sequence: Synthetic polynucleotide
  modified_base (13)..(13): a, c, t, g, unknown or other
  modified_base (40)..(40): a, c, t, g, unknown or other
  misc_feature (67)..(68): This region may encompass 'ca' or 'gg'
  modified_base (95)..(95): a, c, t, g, unknown or other
  modified_base (97)..(97): a, c, t, g, unknown or other
  modified_base (112)..(112): a, c, t, g, unknown or other
  modified_base (137)..(137): a, c, t, g, unknown or other
  modified_base (144)..(144): a, c, t, g, unknown or other
rttcctcaggcancagagaycaatggaractttcagcacngaagtggcctatcaggtctgtcttttsrgaagaacactgtaatagaacagtgcangntgctcacttccttcnttgtaaacccaaaccatggttcttnaagttcnagtgcaataacyttggaataacaaggtatcagtcatctcaattaccacccatagtac

SEQ ID NO: 4734 - DNA, 1788 bp, Artificial Sequence
  Description of Artificial Sequence: Synthetic polynucleotide
  modified_base (25)..(25): a, c, t, g, unknown or other
  modified_base (37)..(37): a, c, t, g, unknown or other
  modified_base (43)..(43): a, c, t, g, unknown or other
  modified_base (105)..(105): a, c, t, g, unknown or other
  modified_base (107)..(107): a, c, t, g, unknown or other
  modified_base (173)..(173): a, c, t, g, unknown or other
  modified_base (202)..(202): a, c, t, g, unknown or other
  modified_base (206)..(206): a, c, t, g, unknown or other
  modified_base (217)..(217): a, c, t, g, unknown or other
  modified_base (219)..(219): a, c, t, g, unknown or other
  modified_base (221)..(221): a, c, t, g, unknown or other
  modified_base (257)..(257): a, c, t, g, unknown or other
  modified_base (312)..(312): a, c, t, g, unknown or other
  modified_base (381)..(381): a, c, t, g, unknown or other
  modified_base (411)..(411): a, c, t, g, unknown or other
  modified_base (414)..(414): a, c, t, g, unknown or other
  modified_base (427)..(427): a, c, t, g, unknown or other
  modified_base (464)..(485): a, c, t, g, unknown or other
  modified_base (557)..(557): a, c, t, g, unknown or other
  modified_base (613)..(613): a, c, t, g, unknown or other
  modified_base (666)..(666): a, c, t, g, unknown or other
  modified_base (847)..(847): a, c, t, g, unknown or other
  modified_base (874)..(874): a, c, t, g, unknown or other
  modified_base (912)..(912): a, c, t, g, unknown or other
  modified_base (984)..(984): a, c, t, g, unknown or other
  modified_base (1004)..(1004): a, c, t, g, unknown or other
  modified_base (1007)..(1007): a, c, t, g, unknown or other
  modified_base (1174)..(1174): a, c, t, g, unknown or other
  modified_base (1296)..(1296): a, c, t, g, unknown or other
  modified_base (1381)..(1381): a, c, t, g, unknown or other
  modified_base (1396)..(1396): a, c, t, g, unknown or other
ataagcttttgtgaaatratatcgntgtctagcaatntactcngtgacctaatgggtccctcaattagagggttgacttccatgtgaggcagaggaaaagaaaanansgtaaatmcaagttcctggaagaaatctgcaatgtctaaaaaagtacacttataagcctcatgatnaggaagaaatgaaatcattttcataaaanattnagaagcaactnancntaggtccttattatagatatgacctatttaaaaganaggttatcttttaaggtctcatggaatacgaatgaagtaagaaagttcttccttncatatcaaaagggatttagatcactcttaccaataaaatataagcaataagaagcataaagattgtacnaatccaatttaaaacctcattggtaaacanganattaataaactgnctaaggaaagcctactcaacacgtgtgawaagcgggnnnnnnnnnnnnnnnnnnnnnncataaaagcctacaacttctgtattgtgacaattttaataattttttccaataaggcaaataaaactgacangcaagaccgcttttctctccactcctgaggcagataagaaatgagtgtttaatcantcatggtttttaactggactataaattctaggagccataataactctgtcttnttccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcntttaataaaatggttaacatttggganaaggcattcaataatgattcattgtgaagtattcacanattcaaaataaagaactctagagctaaaaagtcgtattcaaatagtttagttctttaatttatgtgcacatntttttgtttagacagttctnaancctgaatatttaattttaattgaagtcttcagtattgtatttttctttaattaacmaagtgttgatgatattgaaatgtctacctcaggcactatacctggtctgtatggtttcctttttctctttttgacaccatctgttccttccactcccttagtttcatcatncacagcttcccgctcaggactagattctgattttccatcacaatccataagttctccttctggaaaaaagtaaatgtatacacaaaactggaaaaacctatcaaatatataatccctacatnatggggaataaaaagtagggttgttgctgagccattttaattgtacatccctgttggtagggaaagtatgaaaggagatagaagnagccccaaatggttntagaaattgtgctgcttagtgcagtgttcccatgaaataaaacataatcagagaaggggaacacagaactcagagttctgttaagtgcaayccatttgcacttaacaaattcacttgcttttaattatgtcttcaggtccaggtctctagactagaactctcttctgagcttcaaccacagctataattgaatattacctagttactgaaaactgtrtatccaaaatgaactactaatttaaaataaactttctcctttttcccatgttacctatcatcattaaaaggcatggaaatgtaaccyggagaagacagaggcctggaagaccacctyaatcattcctaatctctttcctcctacaaccaagactyctcaatacctctgaaatgca

SEQ ID NO: 4735 - DNA, 1889 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  misc_feature (998)..(1002): This region may encompass 'cacaa' or is absent in its entirety
  modified_base (1073)..(1073): a, c, t, g, unknown or other
  modified_base (1134)..(1134): a, c, t, g, unknown or other
  modified_base (1280)..(1280): a, c, t, g, unknown or other
  modified_base (1309)..(1309): a, c, t, g, unknown or other
  modified_base (1326)..(1326): a, c, t, g, unknown or other
  modified_base (1337)..(1337): a, c, t, g, unknown or other
  modified_base (1385)..(1385): a, c, t, g, unknown or other
  modified_base (1392)..(1392): a, c, t, g, unknown or other
  modified_base (1397)..(1397): a, c, t, g, unknown or other
  modified_base (1435)..(1435): a, c, t, g, unknown or other
  modified_base (1445)..(1445): a, c, t, g, unknown or other
  modified_base (1460)..(1460): a, c, t, g, unknown or other
  modified_base (1509)..(1509): a, c, t, g, unknown or other
  modified_base (1529)..(1529): a, c, t, g, unknown or other
  modified_base (1555)..(1555): a, c, t, g, unknown or other
  modified_base (1575)..(1575): a, c, t, g, unknown or other
  modified_base (1625)..(1625): a, c, t, g, unknown or other
  modified_base (1629)..(1629): a, c, t, g, unknown or other
  modified_base (1632)..(1632): a, c, t, g, unknown or other
  modified_base (1722)..(1722): a, c, t, g, unknown or other
  modified_base (1769)..(1769): a, c, t, g, unknown or other
  modified_base (1837)..(1837): a, c, t, g, unknown or other
  modified_base (1852)..(1852): a, c, t, g, unknown or other
  modified_base (1882)..(1882): a, c, t, g, unknown or other
  modified_base (1887)..(1887): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaacacaaaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4736 - DNA, 224 bp, Artificial Sequence
  Description of Artificial Sequence: Synthetic polynucleotide
  modified_base (35)..(35): a, c, t, g, unknown or other
  modified_base (83)..(83): a, c, t, g, unknown or other
  modified_base (117)..(117): a, c, t, g, unknown or other
  modified_base (120)..(120): a, c, t, g, unknown or other
  modified_base (124)..(124): a, c, t, g, unknown or other
  modified_base (138)..(138): a, c, t, g, unknown or other
  modified_base (143)..(143): a, c, t, g, unknown or other
  modified_base (160)..(160): a, c, t, g, unknown or other
  modified_base (166)..(166): a, c, t, g, unknown or other
  modified_base (174)..(174): a, c, t, g, unknown or other
  modified_base (181)..(181): a, c, t, g, unknown or other
  modified_base (191)..(191): a, c, t, g, unknown or other
  modified_base (195)..(195): a, c, t, g, unknown or other
  modified_base (199)..(199): a, c, t, g, unknown or other
  modified_base (212)..(212): a, c, t, g, unknown or other
gtactcaaatcaaattggcttacttgcytatattnttgtttttcatggatgttggccccttaagtcctagttgcctcagcaantctctagagcatttacatatgaatatgtgtatanatntatnaagaattgtggtantttanatgctgtaagctacccnatcctngtcaaaanatggggntataaatagntatnaaantatataggtgatnccatgcattgtt

SEQ ID NO: 4737 - DNA, 631 bp, Artificial Sequence
  Description of Artificial Sequence: Synthetic polynucleotide
  modified_base (37)..(37): a, c, t, g, unknown or other
  modified_base (58)..(58): a, c, t, g, unknown or other
  modified_base (61)..(61): a, c, t, g, unknown or other
  modified_base (102)..(102): a, c, t, g, unknown or other
  modified_base (134)..(134): a, c, t, g, unknown or other
  modified_base (138)..(138): a, c, t, g, unknown or other
  modified_base (144)..(144): a, c, t, g, unknown or other
  modified_base (148)..(148): a, c, t, g, unknown or other
  modified_base (171)..(171): a, c, t, g, unknown or other
  modified_base (177)..(177): a, c, t, g, unknown or other
  modified_base (191)..(191): a, c, t, g, unknown or other
  modified_base (201)..(201): a, c, t, g, unknown or other
  modified_base (205)..(205): a, c, t, g, unknown or other
  modified_base (215)..(215): a, c, t, g, unknown or other
  modified_base (231)..(231): a, c, t, g, unknown or other
  modified_base (256)..(256): a, c, t, g, unknown or other
  modified_base (295)..(295): a, c, t, g, unknown or other
  modified_base (319)..(319): a, c, t, g, unknown or other
  modified_base (327)..(327): a, c, t, g, unknown or other
  modified_base (353)..(353): a, c, t, g, unknown or other
  modified_base (356)..(356): a, c, t, g, unknown or other
  modified_base (392)..(392): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (447)..(447): a, c, t, g, unknown or other
  modified_base (454)..(454): a, c, t, g, unknown or other
  modified_base (480)..(480): a, c, t, g, unknown or other
  modified_base (486)..(486): a, c, t, g, unknown or other
  modified_base (493)..(493): a, c, t, g, unknown or other
  modified_base (529)..(529): a, c, t, g, unknown or other
  modified_base (546)..(546): a, c, t, g, unknown or other
  modified_base (554)..(554): a, c, t, g, unknown or other
  modified_base (570)..(570): a, c, t, g, unknown or other
  modified_base (575)..(575): a, c, t, g, unknown or other
  modified_base (590)..(590): a, c, t, g, unknown or other
  modified_base (617)..(617): a, c, t, g, unknown or other
  modified_base (620)..(620): a, c, t, g, unknown or other
ctgaaacagcaattgggaggcccattttactggccantatataattmcattagtaagnagnctagcaaagaataatcatatcaatttcytaatcagctgcanccatgctgaatttgaactggcaaactctgatntgtnagttgntagntgtgatcttcatatcactaaaangaacangataccattctaanaactttacanaganatagtctagnagacattgttctgccntggtcacagtaacaaaaaagtggtnaaaatcagttactttataaatactgataatttgcagcantaaggaacaggacattaaaaaaantaaatttncccataggacacctatgactaggaantcnttcctaagagaagccaaagttttaattattcagttncacaactantgtactgggttacntantctaagaaagaaaaggtgctctacagagntttcccncacacacaaagaatcagcrttaattnagcatnatctctntcattcacagatctggcagattcattaactcatttnaaatgaataaggccaanaggatgcnggaaggtgtggctgantgagntccagggctgtatcncagcttattgatggcaccccattaggnaantgaatacraag

SEQ ID NO: 4738 - DNA, 213 bp, Artificial Sequence
  Description of Artificial Sequence: Synthetic polynucleotide
  modified_base (3)..(3): a, c, t, g, unknown or other
  modified_base (120)..(120): a, c, t, g, unknown or other
  modified_base (129)..(129): a, c, t, g, unknown or other
  modified_base (147)..(147): a, c, t, g, unknown or other
  modified_base (171)..(171): a, c, t, g, unknown or other
  modified_base (187)..(187): a, c, t, g, unknown or other
  modified_base (212)..(212): a, c, t, g, unknown or other
ttncttcagcaatcaaacaaagcaattttattaaacaatgaaaagaatcaattaaaatggatrtctttattatctttattattttacaagaaaccatgacagcttttggtttaaaaaaangtttatagnttcatacagaaatgactnacataaaagaaatttctccagctngctcctacactgtganataaaagttctkttcatattcacana

SEQ ID NO: 4739 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (262)..(262): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttnttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacamtgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 4740 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccrccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4741 - DNA, 337 bp, Artificial Sequence
  Description of Artificial Sequence: Synthetic polynucleotide
  modified_base (5)..(5): a, c, t, g, unknown or other
  modified_base (16)..(16): a, c, t, g, unknown or other
  modified_base (21)..(21): a, c, t, g, unknown or other
  modified_base (39)..(39): a, c, t, g, unknown or other
  modified_base (44)..(44): a, c, t, g, unknown or other
  modified_base (58)..(58): a, c, t, g, unknown or other
  modified_base (88)..(88): a, c, t, g, unknown or other
  modified_base (117)..(117): a, c, t, g, unknown or other
  modified_base (147)..(147): a, c, t, g, unknown or other
  modified_base (191)..(191): a, c, t, g, unknown or other
  modified_base (216)..(216): a, c, t, g, unknown or other
  modified_base (230)..(230): a, c, t, g, unknown or other
  modified_base (235)..(235): a, c, t, g, unknown or other
  modified_base (263)..(263): a, c, t, g, unknown or other
  modified_base (302)..(302): a, c, t, g, unknown or other
ttctntctcatgcctntctgnctrtgtccacagtgtctnaattnaaggtccttggtcntcaaggaaccaagactacactgagatccantcttgggaagygcctctccttcaacctcnggtaccactcatccataaacaccaacactntttgcctctttgtgtatcataaagtccctcattgaaacagcccnttaaactccagtctggaaaacaaanccactgggctacantaagnaccaattttagacacagacatcctcccncttcctcttgaccccaggtattctctgccaaactacaantcctccaggaaatcagcatctagcagcacccccac

SEQ ID NO: 4742 - DNA, 415 bp, Artificial Sequence
  Description of Artificial Sequence: Synthetic polynucleotide
  modified_base (142)..(142): a, c, t, g, unknown or other
  modified_base (228)..(228): a, c, t, g, unknown or other
  modified_base (365)..(365): a, c, t, g, unknown or other
  modified_base (379)..(379): a, c, t, g, unknown or other
  modified_base (397)..(397): a, c, t, g, unknown or other
atggaacgtttaaaatttccctggttactttaactgcaaaagtgagtcttgcatgttatattttacctcttccagcagggcatacagagaggagctagtcagaacamttctttttgacatttatatactgagaagtataccngtgtgttactacagtacatcatggagagtattctatcctttcctttcagttctcatcttttgtcctagattaatagagaacatcangtactgttttcggacagaaaaactaacaagccacctaaacccagtctttctggcctcttaacattaatgttgaactttccttatgcacggtcaacaaagatgcttcaacacttctgtaagcttctccaatcagacantgtgtttcattttntcatctgcaaaaagcagnggaaagagtttccaattt

SEQ ID NO: 4743 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1016)..(1016): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacartgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4744 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (239)..(239): a, c, t, g, unknown or other
  modified_base (241)..(241): a, c, t, g, unknown or other
  modified_base (279)..(279): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (359)..(359): a, c, t, g, unknown or other
  modified_base (389)..(389): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccayccccttcngttctgtggcattgncacaatnaggaatctacttttgtgcttttacacattgaactgacaggtnanrtcaggcatcgactgtcacaggggccagtggagaggtngnagggacgcccacattcgatgaatcctgcatcayggtgttggacttcttgttnttngacactaaacttgttcacattynataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4745 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagkgnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4746 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (594)..(594): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncygcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagangagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4747 - DNA, 275 bp, Artificial Sequence
  Description of Artificial Sequence: Synthetic polynucleotide
  modified_base (9)..(9): a, c, t, g, unknown or other
  modified_base (79)..(79): a, c, t, g, unknown or other
  modified_base (125)..(125): a, c, t, g, unknown or other
  modified_base (147)..(147): a, c, t, g, unknown or other
tcaggaagnttgaaaagtatttatattttttgatacttacttctctttctgctttctctttttcatattgatctatacnttcttttaaatggttaccataattgaatacctcctcatttttctcntttagatgacgttgcattttcntctcaggaaactgaatattaattgttaccttgcttttgttaactttcttatgtgcataaactaattgctgtcgaagccacctatttttgctttctagttkaaataatttctgctccagagactcctgc

SEQ ID NO: 4748 - DNA, 865 bp, Artificial Sequence
  Description of Artificial Sequence: Synthetic polynucleotide
  modified_base (2)..(2): a, c, t, g, unknown or other
  modified_base (226)..(226): a, c, t, g, unknown or other
  modified_base (327)..(327): a, c, t, g, unknown or other
  modified_base (374)..(374): a, c, t, g, unknown or other
  modified_base (444)..(444): a, c, t, g, unknown or other
  modified_base (478)..(478): a, c, t, g, unknown or other
  modified_base (562)..(562): a, c, t, g, unknown or other
  modified_base (656)..(656): a, c, t, g, unknown or other
  modified_base (696)..(696): a, c, t, g, unknown or other
  modified_base (698)..(698): a, c, t, g, unknown or other
  modified_base (766)..(766): a, c, t, g, unknown or other
  modified_base (865)..(865): a, c, t, g, unknown or other
gnttaaatccaaaaaaagtcttgtaagttgcagaaaagtagactgtagcaactgtacgtattttcttcctttcctgctatgaatgtgtttgtatgcagattatgtatttgcatatattaactattcccttcttctatgcgcagtattttacagaagttttattggaggtttcttttccatttgtccattagactagagattactcaaataggttaggattgaattnaagagtaagtgatacgcctcatgactagatagtcagtctcccagagatgggtgtggctgttggaacactacgtctcctcattttgagcagatggtaaaaantgatttctttgtaggaagttgcactctgttggatggaacagttgtgntgttgtacagaaagtcaaatgtgcagggaagggtgtgtatatttcctgagtagccagagggcagccaggnctagccattaaagctgatgtctcttagttgcaancccaycctctgggtttctggtgaagcttgagctctgcacagcaactggctttgcgtgagtctctaccacaagaacacactatgnggagacaataggctagagaaggggaagggatctgtgccttctttttgtctccttgtctgcaccctaatcccatcaaggtcactccttggtaccntcattcagcctggtgaatgaaggccctccaataacaaganangtgtctggttgacaatgtctctgacactaccgacagcttcactatgccccaaagccgccagtgccaancacacagtatcccacctccaaagtcaaaatgagagtgggtgcagtggcagccatgacctagatttgttccttagacaccttagtgttctaatttttggn

SEQ ID NO: 4749 - DNA, 692 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  modified_base (149)..(149): a, c, t, g, unknown or other
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (453)..(453): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (584)..(584): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcayggcaggctctctttcnaaggcaacaggcagggccaccaggctgctgtgtggcnaatangacatnacccagagaagcggcctgagngggccccnccngnctcctgctggctcccrcccacctccc

SEQ ID NO: 4750 - DNA, 144 bp, Artificial Sequence
  Description of Artificial Sequence: Synthetic polynucleotide
  misc_feature (25)..(26): This region may encompass 'ca' or 'tg'
  modified_base (33)..(33): a, c, t, g, unknown or other
  modified_base (63)..(63): a, c, t, g, unknown or other
  modified_base (65)..(65): a, c, t, g, unknown or other
  modified_base (71)..(71): a, c, t, g, unknown or other
  modified_base (75)..(75): a, c, t, g, unknown or other
  modified_base (97)..(97): a, c, t, g, unknown or other
  modified_base (102)..(102): a, c, t, g, unknown or other
  modified_base (111)..(111): a, c, t, g, unknown or other
  modified_base (136)..(136): a, c, t, g, unknown or other
gatgccaacgtcctttccatgcacyrtcagggnacagtgccatttacacatttgggctgtgtntngggagnactngggagctttgagaayctgctgnggccncagcagcantgacaccagagatgactggggtggnattcatgg

SEQ ID NO: 4751 - DNA, 611 bp, Artificial Sequence
  Description of Artificial Sequence: Synthetic polynucleotide
  modified_base (1)..(1): a, c, t, g, unknown or other
  modified_base (3)..(3): a, c, t, g, unknown or other
  modified_base (43)..(43): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (134)..(134): a, c, t, g, unknown or other
  modified_base (140)..(140): a, c, t, g, unknown or other
  modified_base (156)..(156): a, c, t, g, unknown or other
  modified_base (179)..(179): a, c, t, g, unknown or other
  modified_base (189)..(189): a, c, t, g, unknown or other
  modified_base (200)..(200): a, c, t, g, unknown or other
  modified_base (238)..(238): a, c, t, g, unknown or other
  modified_base (249)..(249): a, c, t, g, unknown or other
  modified_base (257)..(257): a, c, t, g, unknown or other
  modified_base (262)..(262): a, c, t, g, unknown or other
  modified_base (267)..(267): a, c, t, g, unknown or other
  modified_base (278)..(278): a, c, t, g, unknown or other
  modified_base (308)..(308): a, c, t, g, unknown or other
  modified_base (349)..(349): a, c, t, g, unknown or other
  modified_base (365)..(365): a, c, t, g, unknown or other
  modified_base (382)..(382): a, c, t, g, unknown or other
  modified_base (421)..(421): a, c, t, g, unknown or other
  modified_base (423)..(423): a, c, t, g, unknown or other
  modified_base (450)..(450): a, c, t, g, unknown or other
  modified_base (473)..(473): a, c, t, g, unknown or other
  modified_base (531)..(531): a, c, t, g, unknown or other
  modified_base (535)..(535): a, c, t, g, unknown or other
  modified_base (541)..(541): a, c, t, g, unknown or other
  modified_base (571)..(571): a, c, t, g, unknown or other
  modified_base (573)..(573): a, c, t, g, unknown or other
  modified_base (575)..(575): a, c, t, g, unknown or other
  modified_base (580)..(580): a, c, t, g, unknown or other
  modified_base (600)..(600): a, c, t, g, unknown or other
  modified_base (608)..(608): a, c, t, g, unknown or other
nanatttacttttaatctcatgagatgctgaggactaagaccncctccttcccagggcccaaagcaagaaaatgnggntgngangaggcccatctccanagatcttacccttggaataagggtctttttcccanacctcnttgacatctattcccnctgggctgtttttattttcctancccacactcntcagctttaangcactaaagaactttttggccacctcagracaaaaatntgttacaaaancacctccnaaatnraatnagctsagcctnactaagtaaatcaggctttggacaggctcngcttcctgttggttgttcatacatttgtgttgctcaagtcnatcttagaacccaacnccgccttgctggattcntgatggaatttctctttgcacctgaacaaytcttcaggnancttctccttttaattttgaagaatgtnatacctttctgtcagaaaaggtntccaggtcttagattcacactcaagccatgaataatactcttctgggcatacataaanacangatttncccaaattctccttctcctagcacagagancncncttcnttccttccctttccctagcnttctttcnaat

SEQ ID NO: 4752 - DNA, 533 bp, Artificial Sequence
  Description of Artificial Sequence: Synthetic polynucleotide
  modified_base (2)..(2): a, c, t, g, unknown or other
  modified_base (50)..(50): a, c, t, g, unknown or other
  modified_base (52)..(52): a, c, t, g, unknown or other
  modified_base (127)..(127): a, c, t, g, unknown or other
  modified_base (141)..(141): a, c, t, g, unknown or other
  modified_base (229)..(229): a, c, t, g, unknown or other
  modified_base (232)..(232): a, c, t, g, unknown or other
  modified_base (255)..(255): a, c, t, g, unknown or other
  modified_base (309)..(309): a, c, t, g, unknown or other
  misc_feature (314)..(318): This region may encompass 'aaaaa' or is absent in its entirety
  modified_base (418)..(418): a, c, t, g, unknown or other
  modified_base (514)..(514): a, c, t, g, unknown or other
cnattcaaaaattaagccaataagaatcaacatataatccatgagattcncnatctaggkaagtaaacccaccctaatactgtgtttattaaaatgctgttaatgagatccgagrtttaaacaactnttcrctttagaaantgaaataaagctgactgaaataaaacctaatctatgaaattattctgtatatgaattgacctgaagtaatgaacagttcawtgactgnctnatractcttgttctggtccaggntaatcattctagttggcatactattaaacacacatttctgattgamacatctgntaaaaaaaataacatcaaacgacattacaaaatcaaaatggagactgctaagagtgggatttttctcctgccagtayctttcctttctgccacatyctcctccctgcynccacagyaatctttctraaggaatacaaatatattctgaatcacacgcaaacccctcaatacagaatgtgtggtaggcagtattctaaaatgcccncataccaccraccccacca

SEQ ID NO: 4753 - DNA, 230 bp, Artificial Sequence
  Description of Artificial Sequence: Synthetic polynucleotide
  modified_base (174)..(174): a, c, t, g, unknown or other
aaaaccagtgtttctagagacatcccatccagcaacctgttctccattcctgcagtttcaatgatttcttcacaagtctcaaagtaaatacaaacactgaattgcagttaacagttcctttcyrtatctctccatctgtctaaaatgagctattattctatacattttattttnaaaatcaatgataggaaaacagaagaaatagaaatggcaggccctgcatttaaatc

SEQ ID NO: 4754 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcrtcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4755 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  misc_feature (641)..(641): May or may not be present
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatcatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4756 - DNA, 265 bp, Artificial Sequence
  Description of Artificial Sequence: Synthetic polynucleotide
  modified_base (6)..(6): a, c, t, g, unknown or other
  modified_base (95)..(95): a, c, t, g, unknown or other
  modified_base (103)..(103): a, c, t, g, unknown or other
  modified_base (112)..(112): a, c, t, g, unknown or other
  modified_base (160)..(160): a, c, t, g, unknown or other
  modified_base (170)..(170): a, c, t, g, unknown or other
  modified_base (205)..(205): a, c, t, g, unknown or other
  modified_base (207)..(207): a, c, t, g, unknown or other
  modified_base (209)..(209): a, c, t, g, unknown or other
  modified_base (216)..(216): a, c, t, g, unknown or other
  modified_base (240)..(240): a, c, t, g, unknown or other
aaacanctccaccaactggacgaamctataacttgttgacagctttytctctctggttctcagatgaggaaygatgataaaacaaaaccaaaagncrtcttantgaggaagntcagctccagtggatttctytgagacaacccaagttagatggagctangggaaaaaanacagkaattctttaaactatcattcaagcaaaacntntnrcctaantgttccttttaaagtagctagacntgttagagattttattgagtggata

SEQ ID NO: 4757 - DNA, 336 bp, Artificial Sequence
  Description of Artificial Sequence: Synthetic polynucleotide
  modified_base (17)..(17): a, c, t, g, unknown or other
  modified_base (19)..(19): a, c, t, g, unknown or other
  modified_base (69)..(69): a, c, t, g, unknown or other
  modified_base (90)..(90): a, c, t, g, unknown or other
  modified_base (103)..(103): a, c, t, g, unknown or other
  modified_base (129)..(129): a, c, t, g, unknown or other
  modified_base (140)..(165): a, c, t, g, unknown or other
  modified_base (268)..(268): a, c, t, g, unknown or other
  modified_base (310)..(310): a, c, t, g, unknown or other
  modified_base (317)..(317): a, c, t, g, unknown or other
tatacatgttctgatantncaaactgaaatctcatcttctttcccactttattgaaagactacaggtanggataaaagaaaactaccaantaacagatctganagtacaaaatatttttaatcatgacntcccccctccnnnnnnnnnnnnnnnnnnnnnnnnnncctttcaagagaaactaacctwctttagatccattgtcaattcttttccagaatctcttaactaaaagatttagttacygtaatgtatatacatacagcaatngcaaaaatgtctttgggataaagacattatcttrtaactcantcaaatnagacaatatgaacatactg

SEQ ID NO: 4758 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacytacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4759 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgrctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4760 - DNA, 113 bp, Artificial Sequence
  Description of Artificial Sequence: Synthetic polynucleotide
  modified_base (74)..(74): a, c, t, g, unknown or other
  modified_base (82)..(82): a, c, t, g, unknown or other
agcctgtggacatctctacagcaatgagtgaacgggcactygctcagaaaagactcagtgagaatgcatttgancttgaagncatgagcatgttaaatagagctcaggaaagg

SEQ ID NO: 4761 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccrtggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4762 - DNA, 420 bp, Artificial Sequence
  Description of Artificial Sequence: Synthetic polynucleotide
  modified_base (3)..(3): a, c, t, g, unknown or other
  modified_base (13)..(13): a, c, t, g, unknown or other
  modified_base (15)..(15): a, c, t, g, unknown or other
  modified_base (17)..(17): a, c, t, g, unknown or other
  modified_base (33)..(33): a, c, t, g, unknown or other
  modified_base (44)..(44): a, c, t, g, unknown or other
  modified_base (67)..(67): a, c, t, g, unknown or other
  modified_base (83)..(83): a, c, t, g, unknown or other
  modified_base (88)..(88): a, c, t, g, unknown or other
  modified_base (119)..(119): a, c, t, g, unknown or other
  modified_base (121)..(121): a, c, t, g, unknown or other
  modified_base (124)..(124): a, c, t, g, unknown or other
  modified_base (129)..(129): a, c, t, g, unknown or other
  modified_base (161)..(161): a, c, t, g, unknown or other
  modified_base (171)..(171): a, c, t, g, unknown or other
  modified_base (187)..(187): a, c, t, g, unknown or other
  modified_base (197)..(197): a, c, t, g, unknown or other
  modified_base (214)..(214): a, c, t, g, unknown or other
  modified_base (220)..(220): a, c, t, g, unknown or other
  modified_base (231)..(231): a, c, t, g, unknown or other
  modified_base (236)..(236): a, c, t, g, unknown or other
  modified_base (242)..(242): a, c, t, g, unknown or other
  modified_base (255)..(255): a, c, t, g, unknown or other
  modified_base (260)..(260): a, c, t, g, unknown or other
  modified_base (263)..(263): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (317)..(317): a, c, t, g, unknown or other
  modified_base (335)..(335): a, c, t, g, unknown or other
  modified_base (351)..(351): a, c, t, g, unknown or other
  modified_base (361)..(361): a, c, t, g, unknown or other
  modified_base (371)..(371): a, c, t, g, unknown or other
  modified_base (404)..(404): a, c, t, g, unknown or other
ccntcacatgccntntnctttatgtaaaaaccntccagcagaanagcaacagtcaccctcaggaggngatttagccccaagtncccanagaacagcctcaggccacgacttctgtgctncntcnctgtncccagmrccatctgccaagaccaggaattcanctttggagtntaacttgttttctctnttttttcacntctcaaaaaataaaaancttcantaatacarccnaaggnttaccntgtgtctaaaagnagganagnttcccataaacaatgttgtcagcttgagtgnggntaaacacagraaggnacacnataaattaaagcagaccntgactcttcagaggcnctgcggtgangtctgggggnccaratctgccagtggctgcatttccagcactncatagtgttgaggact

SEQ ID NO: 4763 - DNA, 394 bp, Artificial Sequence
  Description of Artificial Sequence: Synthetic polynucleotide
  modified_base (7)..(7): a, c, t, g, unknown or other
  modified_base (14)..(14): a, c, t, g, unknown or other
  modified_base (46)..(46): a, c, t, g, unknown or other
  modified_base (51)..(51): a, c, t, g, unknown or other
  modified_base (95)..(95): a, c, t, g, unknown or other
  modified_base (111)..(111): a, c, t, g, unknown or other
  modified_base (120)..(120): a, c, t, g, unknown or other
  modified_base (130)..(130): a, c, t, g, unknown or other
  modified_base (147)..(147): a, c, t, g, unknown or other
  modified_base (184)..(184): a, c, t, g, unknown or other
  modified_base (204)..(204): a, c, t, g, unknown or other
  modified_base (213)..(213): a, c, t, g, unknown or other
  modified_base (227)..(227): a, c, t, g, unknown or other
  modified_base (245)..(245): a, c, t, g, unknown or other
  modified_base (254)..(254): a, c, t, g, unknown or other
  modified_base (260)..(260): a, c, t, g, unknown or other
  modified_base (273)..(273): a, c, t, g, unknown or other
  modified_base (279)..(279): a, c, t, g, unknown or other
  modified_base (301)..(301): a, c, t, g, unknown or other
  modified_base (307)..(307): a, c, t, g, unknown or other
  modified_base (313)..(313): a, c, t, g, unknown or other
  modified_base (320)..(320): a, c, t, g, unknown or other
  modified_base (364)..(364): a, c, t, g, unknown or other
  modified_base (370)..(370): a, c, t, g, unknown or other
  modified_base (373)..(373): a, c, t, g, unknown or other
  modified_base (387)..(387): a, c, t, g, unknown or other
ggcccanctccccnagatgtcacctctctgccttctgagtatcaantcagntctcyttctccctaagcctcccaaactgtggggacttacgtgtnagtgtcatttcagttnttgtatgantatagatacntgaaaaaggaatatttnaaaaattgtcctgacctccctcctcccgacccctgtnggaacccaccacttaaccancaagggccnactcatygagcatnacagcttggggaagaaangccagccgngagccngagaaacaaaaangagggnctgtccctaaaatgcaggatcnaagggnctsganctggagngaaatcaggcagcacctcacrgaatccaggctcacagaaagtcngtttcnatnagaatttaaaacanccctctt

SEQ ID NO: 4764 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcrtgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4765 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (776)..(776): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagrtaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4766 - DNA, 664 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  misc_feature (213)..(214): This region may encompass 'tg' or 'ct'
  modified_base (241)..(241): a, c, t, g, unknown or other
  modified_base (337)..(337): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (426)..(426): a, c, t, g, unknown or other
  modified_base (471)..(471): a, c, t, g, unknown or other
  modified_base (485)..(485): a, c, t, g, unknown or other
  modified_base (499)..(499): a, c, t, g, unknown or other
  modified_base (504)..(504): a, c, t, g, unknown or other
  modified_base (543)..(543): a, c, t, g, unknown or other
  modified_base (557)..(557): a, c, t, g, unknown or other
  modified_base (562)..(562): a, c, t, g, unknown or other
  modified_base (594)..(594): a, c, t, g, unknown or other
  modified_base (597)..(597): a, c, t, g, unknown or other
  modified_base (602)..(602): a, c, t, g, unknown or other
  modified_base (615)..(615): a, c, t, g, unknown or other
  modified_base (640)..(640): a, c, t, g, unknown or other
  modified_base (644)..(644): a, c, t, g, unknown or other
  modified_base (646)..(646): a, c, t, g, unknown or other
  modified_base (648)..(648): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcykgctgccaacaccgcacccttcccaccngtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggnggtaagagggctcgccagagccagnaggngngngggcagggtccctgtg

SEQ ID NO: 4767 - DNA, 175 bp, Artificial Sequence
  Description of Artificial Sequence: Synthetic polynucleotide
  modified_base (24)..(24): a, c, t, g, unknown or other
  modified_base (29)..(29): a, c, t, g, unknown or other
  misc_feature (51)..(52): This region may encompass 'ca' or 'ag'
  modified_base (58)..(58): a, c, t, g, unknown or other
  modified_base (86)..(86): a, c, t, g, unknown or other
  modified_base (104)..(104): a, c, t, g, unknown or other
  modified_base (108)..(108): a, c, t, g, unknown or other
  modified_base (112)..(112): a, c, t, g, unknown or other
  modified_base (125)..(125): a, c, t, g, unknown or other
  modified_base (127)..(127): a, c, t, g, unknown or other
  modified_base (130)..(130): a, c, t, g, unknown or other
  modified_base (136)..(136): a, c, t, g, unknown or other
aaagattatgatgcactggcctgntctangacttcactgcattcatcagcmrcagganacaaagacatgcacttttttcataattnttttagtaataattgacnattngagnaaatgaatggcanrnaanaattangggcagacaagatggtcagcaaatcaaactgggaaatgc

SEQ ID NO: 4768 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaasaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4769 - DNA, 226 bp, Artificial Sequence
  Description of Artificial Sequence: Synthetic polynucleotide
  modified_base (31)..(31): a, c, t, g, unknown or other
  modified_base (126)..(126): a, c, t, g, unknown or other
  modified_base (134)..(134): a, c, t, g, unknown or other
  modified_base (154)..(154): a, c, t, g, unknown or other
  modified_base (179)..(179): a, c, t, g, unknown or other
  modified_base (216)..(216): a, c, t, g, unknown or other
gattcagtttattttcttcatttgtgcacantgctgcttgttagtgaatttacttaaggacacaagaaggtgyaatctttctgccaaattggtactgtcttactagacacaagattcatctcactngtaatttnttcccttaatgaatctgtanttcttcacaacttactgaagtctcnaaaaaaaaaaggcaggactagtggtggtaaattctanacagtggaat

SEQ ID NO: 4770 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagmtctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4771 - DNA, 255 bp, Artificial Sequence
  Description of Artificial Sequence: Synthetic polynucleotide
  modified_base (44)..(44): a, c, t, g, unknown or other
  modified_base (100)..(100): a, c, t, g, unknown or other
  modified_base (152)..(152): a, c, t, g, unknown or other
  modified_base (163)..(163): a, c, t, g, unknown or other
  modified_base (227)..(227): a, c, t, g, unknown or other
  modified_base (247)..(247): a, c, t, g, unknown or other
atttagtctaccaaactacaattagtgttgttttcatttttgtnctctatatgcatgttgccatttttacacttcttcagaaaaacattgagaatttttntacactyactatttccatttgtgcctaaggacaactttttctttttcttctntttttttttgnaagaaattygtttatgaacttagataaaatttatagctttgcttgaaaatttggtacttactanctttgcaattctctttattnattattac

SEQ ID NO: 4772 - DNA, 693 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  misc_feature (60)..(61): This region may encompass 'aa' or 'cg'
  modified_base (104)..(104): a, c, t, g, unknown or other
  modified_base (132)..(132): a, c, t, g, unknown or other
  modified_base (144)..(144): a, c, t, g, unknown or other
  modified_base (150)..(150): a, c, t, g, unknown or other
  modified_base (176)..(176): a, c, t, g, unknown or other
  modified_base (213)..(213): a, c, t, g, unknown or other
  modified_base (216)..(216): a, c, t, g, unknown or other
  modified_base (223)..(223): a, c, t, g, unknown or other
  modified_base (225)..(225): a, c, t, g, unknown or other
  modified_base (239)..(239): a, c, t, g, unknown or other
  modified_base (242)..(242): a, c, t, g, unknown or other
  modified_base (312)..(312): a, c, t, g, unknown or other
  modified_base (323)..(323): a, c, t, g, unknown or other
  modified_base (338)..(338): a, c, t, g, unknown or other
  modified_base (371)..(371): a, c, t, g, unknown or other
  modified_base (405)..(405): a, c, t, g, unknown or other
  modified_base (435)..(435): a, c, t, g, unknown or other
  modified_base (447)..(447): a, c, t, g, unknown or other
  modified_base (454)..(454): a, c, t, g, unknown or other
  modified_base (473)..(473): a, c, t, g, unknown or other
  modified_base (483)..(483): a, c, t, g, unknown or other
  modified_base (492)..(492): a, c, t, g, unknown or other
  modified_base (515)..(515): a, c, t, g, unknown or other
  modified_base (523)..(523): a, c, t, g, unknown or other
  modified_base (530)..(530): a, c, t, g, unknown or other
  modified_base (540)..(540): a, c, t, g, unknown or other
  modified_base (569)..(569): a, c, t, g, unknown or other
  modified_base (585)..(585): a, c, t, g, unknown or other
  modified_base (622)..(622): a, c, t, g, unknown or other
  modified_base (627)..(627): a, c, t, g, unknown or other
  modified_base (633)..(633): a, c, t, g, unknown or other
  modified_base (654)..(654): a, c, t, g, unknown or other
  modified_base (662)..(662): a, c, t, g, unknown or other
  modified_base (665)..(665): a, c, t, g, unknown or other
  modified_base (667)..(667): a, c, t, g, unknown or other
cncagtcaagtaaaaagaaacgcaactaaaagagcngtcagttaaatacattcctctctmrtggcaggacragtctataagatttgttttgtttttaatttagnagtttttttaatgtttaaaccttgtganacatcaaattanatgctngaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

(The sequence listing continues in the following parts.)

What is claimed is:

1. A multiplex method for identifying the presence or absence of an aneuploidy of a target chromosome in a sample from a pregnant female subject, which comprises:
    a. providing about 20 to about 56 amplification primer pairs, wherein each amplification primer pair specifically hybridizes with polynucleotides of a nucleotide sequence species set, wherein: i) the polynucleotides of a nucleotide sequence species set are present on two or more different chromosomes at different loci, comprising a target chromosome and one or more reference chromosomes not associated with the aneuploidy; (ii) the polynucleotides of a nucleotide sequence species set differ by one or more mismatch nucleotides; (iii) the polynucleotides of a nucleotide sequence species set are reproducibly amplified by a single pair of amplification primers relative to each other; (iv) each amplified polynucleotide in a nucleotide sequence species set comprises a nucleotide sequence having the one or more mismatch nucleotides and (v) the polynucleotides of the nucleotide sequence species sets have nucleotide sequences corresponding to SEQ ID NOs: 4736, 4808, 4258, 4413, 4537, 4692, 4203, 4077, 4697, 4436, 3869, 4475, 4078, 4396, 4782, 4683, 4279, 3940, 4236, 3865, 4733, 4168, 3818, 4563, 4906, 3807, 3849, 4594, 4022, 4538, 4219, 4548, 4382, 4374, 4444, 4305, 4403, 4307, 4059, 4767, 3994, 4561, 4209, 3850, 4686, 3985, 4608, 3963, 4038, 4948, 4468, 4879, 4196, 3967, 4150 and 4102;
    b. contacting in one or more reaction vessels under amplification conditions, extracellular nucleic acid of the sample comprising fetally derived and maternally derived nucleic acid with amplification primer pairs consisting of the about 20 to about 56 amplification primer pairs of (a), wherein about 10 to about 25 of the amplification primer pairs are in each of the one or more reaction vessels, and each primer pair amplifies only a single nucleotide species set in the reaction vessel, thereby producing about 20 to about 56 species sets of amplified polynucleotides;
    c. determining the amount of each amplified polynucleotide in each set by detecting the one or more mismatch nucleotides in each amplified polynucleotide by primer extension, sequencing, Q-PCR or mass spectrometry;

d. determining a ratio between the relative amount of (i) an amplified target polynucleotide and (ii) an amplified reference polynucleotide, for each set; and e. identifying the presence or absence of an aneuploidy of a target chromosome based on the ratios from the about 20 to about 56 species sets of amplified polynucleotides.

2. The method of claim 1, wherein the extracellular nucleic acid is from blood, blood plasma or blood serum of the pregnant female subject.

3. The method of claim 2, wherein the extracellular nucleic acid is from a female subject in the first trimester of pregnancy, second trimester of pregnancy or third trimester of pregnancy.

4. The method of claim 1, wherein the fetal nucleic acid is about 5% to about 40% of the extracellular nucleic acid; or the number of fetal nucleic acid copies is about 10 copies to about 2000 copies of the total extracellular nucleic acid.

5. The method of claim 1, which comprises enriching the extracellular nucleic acid for fetal nucleic acid.

6. The method of claim 1, which comprises determining the fetal nucleic acid concentration in the extracellular nucleic acid.

7. The method of claim 1, wherein the amounts of the amplified polynucleotides in each set vary by up to a value that permits detection of the aneuploidy of a target chromosome with a confidence level of about 95% or more.

8. The method of claim 1, wherein the amounts of the amplified polynucleotides in each set vary by up to a value that permits detection of the aneuploidy of a target chromosome with a sensitivity of about 90% or more, and a specificity of about 95% or more.

9. The method of claim 1, wherein the number of sets of amplified polynucleotides is based on (i) the number of sets that provides a 85% or greater sensitivity for determining the absence of the aneuploidy of a target chromosome, (ii) the number of sets that provides a 85% or greater specificity for determining the presence of the aneuploidy of a target chromosome or (i) the number of sets that provides a 85% or greater sensitivity for determining the absence of the aneuploidy of a target chromosome and (ii) the number of sets that provides a 85% or greater specificity for determining the presence of the aneuploidy of a target chromosome.

10. The method of claim 1, wherein identifying the presence or absence of an aneuploidy of a target chromosome is based on the ratios from about 56 species sets of amplified polynucleotides.

11. The method of claim 1, wherein detecting the one or more mismatch nucleotides in each amplified polynucleotide in a set is by primer extension.

12. The method of claim 1, wherein detecting the one or more mismatch nucleotides in each amplified polynucleotide in a set is by sequencing.

13. The method of claim 1, wherein detecting the one or more mismatch nucleotides in each amplified polynucleotide in a set is by Q-PCR.

14. The method of claim 1, wherein detecting the one or more mismatch nucleotides in each amplified polynucleotide in a set is by mass spectrometry.

15. The method of claim 1, wherein 56 amplification primer pairs are provided.

16. The method of claim 1, wherein the amplification primer pairs are selected from the primer pairs of the group consisting of:

| | SEQ ID NO: |
|---|---|
| GTACTCAAATCAAATTGGC | 5010 |
| GAAAAAAGTGCATGTCTTTG | 5011 |
| CCCAGATGAAGGGGTTTTAG | 5012 |
| AAGACCAAGATTCAGAAGC | 5013 |
| GTGAATTCTTCCCACTTCTC | 5014 |
| GAGAATTAAAATGAACTGAG | 5015 |
| GGTACCACTCATCCATAAAC | 5016 |
| ACCCTCAGTACCACTATCTC | 5017 |
| CAAGGATTCCAGTACTGGAG | 5018 |
| CATATTTGTCTGTGTACTTG | 5019 |
| GGAATGTTCCACCTTTCTAC | 5020 |
| CTTCAAGGCAATCTTTCTCC | 5021 |
| ACCAGCTACATCTAGATTAC | 5022 |
| AGCTCCGCTTTGATTTCAGG | 5023 |
| TTCCTGATGATAATCTTCCC | 5024 |
| AACGGCCAGGGTGGACACT | 5025 |
| GATGCTTCTAAGGACCATGT | 5026 |
| CCATAGCAAGATGAATTCAC | 5027 |
| CACCAGTATCAGCAATAGCTT | 5028 |
| GTGCCTAAGGACAACTTTTC | 5029 |
| GAACCATGGTTTGGGTTTAC | 5030 |
| AATAAAGTCCAGAGTATGGC | 5031 |
| ATTCCAAGGGCTATCTCCAC | 5032 |
| GCTGGATACCTAATTAATGC | 5033 |
| AGGTAGTTCTCTAAGTTAC | 5034 |
| ACAAATATTGACAGGCAGCA | 5035 |
| GAACAGCTATATTTCAAACCC | 5036 |
| CTTCCTGTGAACCTGCTTTC | 5037 |
| GAGGCCAATGCAAATGTAGG | 5038 |
| CTTATCCTTTGGGTCTTCTC | 5039 |
| TTGTGTGTAGGATTATGAGC | 5040 |
| GAATGTAGCTGTTGTTAGGG | 5041 |
| TCCCTCTCTCCCTGAAAAAG | 5042 |
| GACTAGGTTACTGAGCAAGG | 5043 |
| TTAGATTGTTATCCCCACT | 5044 |
| AAGAACTCCAGGGCTACTTG | 5045 |
| TGGTTCTCAACACTGACCAC | 5046 |
| ATGTAGGCATTGTAATGAGG | 5047 |
| GATAACATAAGATTAGGAAC | 5048 |

| | SEQ ID NO: |
|---|---|
| GATTATGATGCACTGGCCTG | 5049 |
| CTGAAGAAGTGTAAAAATGGC | 5050 |
| CTGCTAACTCAGATACCTGC | 5051 |
| GTCTCACATCCCATTTACAG | 5052 |
| TCAATTAGAAATCTAGTGC | 5053 |
| TATATAATACTTAGTTTTGG | 5054 |
| TTCCTTTATGGGAGGAGGAG | 5055 |
| ATTGGCCAACATCTCAACAG | 5056 |
| GTGTGCTTGCCTCCTAATTT | 5057 |
| GAAAGTTCTTGTATTAAAAG | 5058 |
| TGTTCTTGGTTGACTTTAC | 5059 |
| CTTTTACCAGTTATCTTCC | 5060 |
| CATGGGCAAACATAATTTGG | 5061 |
| CTGTGTCAATGGCACATCTG | 5062 |
| ATATTTCAAGTATCACTATG | 5063 |
| GCATCAGGACAAACTGATGG | 5064 |
| GTGCTATAAAGCTTTAACAAG | 5065 |
| GAGGCAACTAGGACTTAAGG | 5066 |
| AGATTATGATGCACTGGCCT | 5067 |
| GGAAAGTTAGAAGGCCACAC | 5068 |
| TTGTTGCTCCAAGTTTAAG | 5069 |
| GTTTTCCCATATCTAGATGTC | 5070 |
| TACTTAATCCTTTTGCCTC | 5071 |
| GGGCTGTTTCAATGAGGGAC | 5072 |
| CTTGTATTAAAAGAAGTGG | 5073 |
| GGAGTCAAGGGAGCATTTTA | 5074 |
| GAGGCAAACATTATACACAC | 5075 |
| ACTGAAGTCATTCATTAGG | 5076 |
| GCAGGTTCACAGGAAGTTTC | 5077 |
| CTGTGAGGCCAATGCAAATG | 5078 |
| GTGGCTATGAAAGACAGCCT | 5079 |
| GGGAAGATCTTAAAGGGAGC | 5080 |
| ACACCACATTTCTACCACTG | 5081 |
| TGATACAGAAATGTCAACCC | 5082 |
| CTCCCCAAAGTCTCGATAG | 5083 |
| GGAACAGTGTTGATAAAGACT | 5084 |
| CCAAATTTTCAAGCAAAGC | 5085 |

| | SEQ ID NO: |
|---|---|
| GAAGTGGCCTATCAGGTCT | 5086 |
| GGACTTTGGCACCCAAGGA | 5087 |
| TTCCTACCTCACTTGGCTTC | 5088 |
| GTTACACTGCAAAGCATTTC | 5089 |
| GGCAAACATAATTTGGATGGG | 5090 |
| CTGTGTCAAATATGTGACTG | 5091 |
| TTTCAGACCATTTTTGAAC | 5092 |
| AAGAGGGAAGATGACTTTTC | 5093 |
| CAGAGGGTAGAAGGGAGGC | 5094 |
| GAGTTCTAGTTTGGCAAACTT | 5095 |
| ATGCTGATGAACCGCACTTC | 5096 |
| CTGGGCAACTGTGAAAAGAC | 5097 |
| GACCAAAGTGTATACATAG | 5098 |
| CCTTTTAAAATATGCACGAG | 5099 |
| TAAATGAGCAGAGACTCAAG | 5100 |
| AAAGCTTTAACAAGTTGGCG | 5101 |
| GTTGTGACTATTGTTATAG | 5102 |
| GACTTGAATTTAACTGCTCC | 5103 |
| AACTTGCCTTCAAGATCTG | 5104 |
| GAAAAAAGTGCATGTCTTTG | 5105 |
| GTCTACCAAACTACAATTAG | 5106 |
| CTTTCCAAAAACCCACAATC | 5107 |
| AGGGCTGCAGGGACAGTAG | 5108 |
| TATTTTTATTTCCAATGTAG | 5109 |
| TCATCCCCATTTCTCAACTC | 5110 |
| GCTGATCAAGGCAGTTTTTC | 5111 |
| TTTAGCATTCCCAGACTCAG | 5112 |
| ACTGTTATGTACATTATATC | 5113 |
| ACCCTCAGTACCACTATCTC | 5114 |
| TGTGTGCAAGGCTCTAGAAG | 5115 |
| CCAAGGTTGCTTATAAACAG | 5116 |
| GTTCTCTAAGTTACCAAAATC | 5117 |
| GTATATATAACTCCTGATC | 5118 |
| CAGCATAGCTTTAATGGTCC | 5119 |
| TCTGTGACACAGAGCATGAG | 5120 |
| AACTCCAGGGCTACTTGAAC | 5121. |

* * * * *